United States Patent 7,691,997 (FUNCTIONAL AND HYPERFUNCTIONAL SIRNA) - sequence listing, part 39

SEQ ID NO: 1584958 - RNA, 19 nt, Homo sapiens
uagaagcaaaguuaagaga

SEQ ID NO: 1584959 - RNA, 19 nt, Homo sapiens
ccuccaacuugacaucaug

SEQ ID NO: 1584960 - RNA, 19 nt, Homo sapiens
gaagucacagaacaguaau

SEQ ID NO: 1584961 - RNA, 19 nt, Homo sapiens
aaaugcaggguaaggagua

SEQ ID NO: 1584962 - RNA, 19 nt, Homo sapiens
gagaugugccagcuguuca

SEQ ID NO: 1584963 - RNA, 19 nt, Homo sapiens
caggaaaguuugagaaaag

SEQ ID NO: 1584964 - RNA, 19 nt, Homo sapiens
gcgcugcucgaaaggguuu

SEQ ID NO: 1584965 - RNA, 19 nt, Homo sapiens
uuucaagacaggaaucaaa

SEQ ID NO: 1584966 - RNA, 19 nt, Homo sapiens
acguguguaucaaguauga

SEQ ID NO: 1584967 - RNA, 19 nt, Homo sapiens
caaacugcgcucuaauaag

SEQ ID NO: 1584968 - RNA, 19 nt, Homo sapiens
ccacaaacugcgcucuaau

SEQ ID NO: 1584969 - RNA, 19 nt, Homo sapiens
aaagagcagagcuuacuuc

SEQ ID NO: 1584970 - RNA, 19 nt, Homo sapiens
cacacucgguuccucacaa

SEQ ID NO: 1584971 - RNA, 19 nt, Homo sapiens
accacaaacugcgcucuaa

SEQ ID NO: 1584972 - RNA, 19 nt, Homo sapiens
uaaagagcagagcuuacuu

SEQ ID NO: 1584973 - RNA, 19 nt, Homo sapiens
agacaggaagcguuucaga

SEQ ID NO: 1584974 - RNA, 19 nt, Homo sapiens
gcuguucaccaccgagcua

SEQ ID NO: 1584975 - RNA, 19 nt, Homo sapiens
gcaggaucaggaaaguuug

SEQ ID NO: 1584976 - RNA, 19 nt, Homo sapiens
gcagaggucacagggaagu

SEQ ID NO: 1584977 - RNA, 19 nt, Homo sapiens
caacguggacacacuuggu

SEQ ID NO: 1584978 - RNA, 19 nt, Homo sapiens
ucaggaaaguuugagaaaa

SEQ ID NO: 1584979 - RNA, 19 nt, Homo sapiens
agcugaaccucacacugua

SEQ ID NO: 1584980 - RNA, 19 nt, Homo sapiens
cugaaucaaggaucacaaa

SEQ ID NO: 1584981 - RNA, 19 nt, Homo sapiens
caccacugccuucauuuca

SEQ ID NO: 1584982 - RNA, 19 nt, Homo sapiens
gagaagagauugaagcuuu

SEQ ID NO: 1584983 - RNA, 19 nt, Homo sapiens
gagaaagacugcaaacaug

SEQ ID NO: 1584984 - RNA, 19 nt, Homo sapiens
caacugaggugguucugaa

SEQ ID NO: 1584985 - RNA, 19 nt, Homo sapiens
caucgaaucuccuggguuu

SEQ ID NO: 1584986 - RNA, 19 nt, Homo sapiens
gagagcggcugguucauug

SEQ ID NO: 1584987 - RNA, 19 nt, Homo sapiens
caaagaugcuggcuauauc

SEQ ID NO: 1584988 - RNA, 19 nt, Homo sapiens
ccaacaaacccaacucuaa

SEQ ID NO: 1584989 - RNA, 19 nt, Homo sapiens
gagacugguucgcuuguuu

SEQ ID NO: 1584990 - RNA, 19 nt, Homo sapiens
gagcccacccuaaccauua

SEQ ID NO: 1584991 - RNA, 19 nt, Homo sapiens
ccauuaagcuagagcaaga

SEQ ID NO: 1584992 - RNA, 19 nt, Homo sapiens
ccggagagauugccauuga

SEQ ID NO: 1584993 - RNA, 19 nt, Homo sapiens
caacuuggacugcaccuuu

SEQ ID NO: 1584994 - RNA, 19 nt, Homo sapiens
caacuucaacccucacuuu

SEQ ID NO: 1584995 - RNA, 19 nt, Homo sapiens
gcuacuacgucaaauccua

SEQ ID NO: 1584996 - RNA, 19 nt, Homo sapiens
caacaaacccaacucuaau

SEQ ID NO: 1584997 - RNA, 19 nt, Homo sapiens
gaacagcacccaaaacaaa

SEQ ID NO: 1584998 - RNA, 19 nt, Homo sapiens
gaacccaaccagaagauug

SEQ ID NO: 1584999 - RNA, 19 nt, Homo sapiens
gaagggaacaugcacuaug

SEQ ID NO: 1585000 - RNA, 19 nt, Homo sapiens
gggauucaauugcaacuuc

SEQ ID NO: 1585001 - RNA, 19 nt, Homo sapiens
gaaagacugcaaacauguu

SEQ ID NO: 1585002 - RNA, 19 nt, Homo sapiens
gaccggacguuuccagaug

SEQ ID NO: 1585003 - RNA, 19 nt, Homo sapiens
gaagcacgacugcaaguau

SEQ ID NO: 1585004 - RNA, 19 nt, Homo sapiens
gugcggaggucguuugaau

SEQ ID NO: 1585005 - RNA, 19 nt, Homo sapiens
ccaaagaugcuggcuauau

SEQ ID NO: 1585006 - RNA, 19 nt, Homo sapiens
cgacauggaguaccagauu

SEQ ID NO: 1585007 - RNA, 19 nt, Homo sapiens
aagggaacaugcacuauga

SEQ ID NO: 1585008 - RNA, 19 nt, Homo sapiens
gaauggcuacuacgucaaa

SEQ ID NO: 1585009 - RNA, 19 nt, Homo sapiens
gaacugcagcuuugaggau

SEQ ID NO: 1585010 - RNA, 19 nt, Homo sapiens
caagacaggcucugaagau

SEQ ID NO: 1585011 - RNA, 19 nt, Homo sapiens
uuucuuagcccucuacuuu

SEQ ID NO: 1585012 - RNA, 19 nt, Homo sapiens
gagcauuugugcgcaaguu

SEQ ID NO: 1585013 - RNA, 19 nt, Homo sapiens
ccugagcacucuuaucaau

SEQ ID NO: 1585014 - RNA, 19 nt, Homo sapiens
cgagaaagacugcaaacau

SEQ ID NO: 1585015 - RNA, 19 nt, Homo sapiens
gacauggaguaccagauug

SEQ ID NO: 1585016 - RNA, 19 nt, Homo sapiens
gggauggcauuccacaugu

SEQ ID NO: 1585017 - RNA, 19 nt, Homo sapiens
gcugagggccgaagcaaga

SEQ ID NO: 1585018 - RNA, 19 nt, Homo sapiens
gaacugcgaguggauuguu

SEQ ID NO: 1585019 - RNA, 19 nt, Homo sapiens
caaacauguugccucgauu

SEQ ID NO: 1585020 - RNA, 19 nt, Homo sapiens
ggagagauugccauugaug

SEQ ID NO: 1585021 - RNA, 19 nt, Homo sapiens
ccagagagagggccaguau

SEQ ID NO: 1585022 - RNA, 19 nt, Homo sapiens
gaacuuucagugcaauguu

SEQ ID NO: 1585023 - RNA, 19 nt, Homo sapiens
gcuccaugcucuacaucaa

SEQ ID NO: 1585024 - RNA, 19 nt, Homo sapiens
gaggagcccugugguugga

SEQ ID NO: 1585025 - RNA, 19 nt, Homo sapiens
ucaauugcaacuucgauuu

SEQ ID NO: 1585026 - RNA, 19 nt, Homo sapiens
gaacacccaagacagugaa

SEQ ID NO: 1585027 - RNA, 19 nt, Homo sapiens
cauggagucuggccggauu

SEQ ID NO: 1585028 - RNA, 19 nt, Homo sapiens
caaguacugugggaccaaa

SEQ ID NO: 1585029 - RNA, 19 nt, Homo sapiens
ggauggcauuccacauguu

SEQ ID NO: 1585030 - RNA, 19 nt, Homo sapiens
aaacauguugccucgauuu

SEQ ID NO: 1585031 - RNA, 19 nt, Homo sapiens
guuagaauccgcccucaga

SEQ ID NO: 1585032 - RNA, 19 nt, Homo sapiens
aaacacagaauggcuacua

SEQ ID NO: 1585033 - RNA, 19 nt, Homo sapiens
gaacagaucagugccucau

SEQ ID NO: 1585034 - RNA, 19 nt, Homo sapiens
ucuuugaccuggagcauga

SEQ ID NO: 1585035 - RNA, 19 nt, Homo sapiens
gacaggcucugaagauugc

SEQ ID NO: 1585036 - RNA, 19 nt, Homo sapiens
gagagauugccauugauga

SEQ ID NO: 1585037 - RNA, 19 nt, Homo sapiens
ggaggucguuugaauucca

SEQ ID NO: 1585038 - RNA, 19 nt, Homo sapiens
gcggaggucguuugaauuc

SEQ ID NO: 1585039 - RNA, 19 nt, Homo sapiens
agugaaaggugucaucauc

SEQ ID NO: 1585040 - RNA, 19 nt, Homo sapiens
gaugcucccugcuccaaca

SEQ ID NO: 1585041 - RNA, 19 nt, Homo sapiens
caacacagggagcgauuuc

SEQ ID NO: 1585042 - RNA, 19 nt, Homo sapiens
uagagaacuuucagugcaa

SEQ ID NO: 1585043 - RNA, 19 nt, Homo sapiens
ucgccuaguuucuguguga

SEQ ID NO: 1585044 - RNA, 19 nt, Homo sapiens
gaacccaucucggcuuuug

SEQ ID NO: 1585045 - RNA, 19 nt, Homo sapiens
ggaacacccaagacaguga

SEQ ID NO: 1585046 - RNA, 19 nt, Homo sapiens
ugagagagcggcugguuca

SEQ ID NO: 1585047 - RNA, 19 nt, Homo sapiens
ggggagaacugcagcuuug

SEQ ID NO: 1585048 - RNA, 19 nt, Homo sapiens
caaggacugggaauacauu

SEQ ID NO: 1585049 - RNA, 19 nt, Homo sapiens
ugaaaggugucaucaucca

SEQ ID NO: 1585050 - RNA, 19 nt, Homo sapiens
ucagguagaucugggaaca

SEQ ID NO: 1585051 - RNA, 19 nt, Homo sapiens
aagacaggcucugaagauu

SEQ ID NO: 1585052 - RNA, 19 nt, Homo sapiens
guaugacuuuaucgagauu

SEQ ID NO: 1585053 - RNA, 19 nt, Homo sapiens
ucccauaccuccucucagu

SEQ ID NO: 1585054 - RNA, 19 nt, Homo sapiens
uguggaagccagagcauuu

SEQ ID NO: 1585055 - RNA, 19 nt, Homo sapiens
uuccaaagaugcuggcuau

SEQ ID NO: 1585056 - RNA, 19 nt, Homo sapiens
caacgggaccaucgaaucu

SEQ ID NO: 1585057 - RNA, 19 nt, Homo sapiens
ggcaaacacugugggaaca

SEQ ID NO: 1585058 - RNA, 19 nt, Homo sapiens
acucaaggcucagcugguu

SEQ ID NO: 1585059 - RNA, 19 nt, Homo sapiens
gauugccauugaugacauu

SEQ ID NO: 1585060 - RNA, 19 nt, Homo sapiens
agaagauuguccucaacuu

SEQ ID NO: 1585061 - RNA, 19 nt, Homo sapiens
gaagaggaggccacagagu

SEQ ID NO: 1585062 - RNA, 19 nt, Homo sapiens
ggcaaggacugggaauaca

SEQ ID NO: 1585063 - RNA, 19 nt, Homo sapiens
aggaguggcuucagguaga

SEQ ID NO: 1585064 - RNA, 19 nt, Homo sapiens
ccaacaacgaugcaacuga

SEQ ID NO: 1585065 - RNA, 19 nt, Homo sapiens
gagaggacuggauggugua

SEQ ID NO: 1585066 - RNA, 19 nt, Homo sapiens
ggaagucagcacuaaugga

SEQ ID NO: 1585067 - RNA, 19 nt, Homo sapiens
gcuccauggugaugacaau

SEQ ID NO: 1585068 - RNA, 19 nt, Homo sapiens
caaaacacccucugaacuu

SEQ ID NO: 1585069 - RNA, 19 nt, Homo sapiens
aacuuggacugcaccuuua

SEQ ID NO: 1585070 - RNA, 19 nt, Homo sapiens
gcuacgacauggaguacca

SEQ ID NO: 1585071 - RNA, 19 nt, Homo sapiens
aagcacgacugcaaguaug

SEQ ID NO: 1585072 - RNA, 19 nt, Homo sapiens
ucacggccaucgcaacaca

SEQ ID NO: 1585073 - RNA, 19 nt, Homo sapiens
ccucaucuaccuacucuga

SEQ ID NO: 1585074 - RNA, 19 nt, Homo sapiens
ugagaaguauccacacaac

SEQ ID NO: 1585075 - RNA, 19 nt, Homo sapiens
caaguucaccuccgacuac

SEQ ID NO: 1585076 - RNA, 19 nt, Homo sapiens
acaugugugugugugaaua

SEQ ID NO: 1585077 - RNA, 19 nt, Homo sapiens
agacaugugugugugugaa

SEQ ID NO: 1585078 - RNA, 19 nt, Homo sapiens
gcagagugacagccagaga

SEQ ID NO: 1585079 - RNA, 19 nt, Homo sapiens
gcaaggacugggaauacau

SEQ ID NO: 1585080 - RNA, 19 nt, Homo sapiens
uggaacccaucucggcuuu

SEQ ID NO: 1585081 - RNA, 19 nt, Homo sapiens
aaagucuccuacagccuaa

SEQ ID NO: 1585082 - RNA, 19 nt, Homo sapiens
gaagauaagccacaaauga

SEQ ID NO: 1585083 - RNA, 19 nt, Homo sapiens
gcaaacaccucgucaggaa

SEQ ID NO: 1585084 - RNA, 19 nt, Homo sapiens
ggaauucgcagacuccaua

SEQ ID NO: 1585085 - RNA, 19 nt, Homo sapiens
cgaaagccauucccacaaa

SEQ ID NO: 1585086 - RNA, 19 nt, Homo sapiens
gcagucaacucaaaugcaa

SEQ ID NO: 1585087 - RNA, 19 nt, Homo sapiens
gcgcggaccuggagauuau

SEQ ID NO: 1585088 - RNA, 19 nt, Homo sapiens
gcgcggaggugaaggagaa

SEQ ID NO: 1585089 - RNA, 19 nt, Homo sapiens
caacacaaauucagaacgu

SEQ ID NO: 1585090 - RNA, 19 nt, Homo sapiens
ggacucagagcgaucgaua

SEQ ID NO: 1585091 - RNA, 19 nt, Homo sapiens
ccagagaaaccaauaagaa

SEQ ID NO: 1585092 - RNA, 19 nt, Homo sapiens
gguccaagcggaaagauaa

SEQ ID NO: 1585093 - RNA, 19 nt, Homo sapiens
cgucauggcguuugguuua

SEQ ID NO: 1585094 - RNA, 19 nt, Homo sapiens
caaagugaaggaacaguuu

SEQ ID NO: 1585095 - RNA, 19 nt, Homo sapiens
gagacacgcccuccaugua

SEQ ID NO: 1585096 - RNA, 19 nt, Homo sapiens
ucacaaacacggaggauga

SEQ ID NO: 1585097 - RNA, 19 nt, Homo sapiens
caacaacacaaauucagaa

SEQ ID NO: 1585098 - RNA, 19 nt, Homo sapiens
gagaacaauucgagagaca

SEQ ID NO: 1585099 - RNA, 19 nt, Homo sapiens
gggagcaagucauagagaa

SEQ ID NO: 1585100 - RNA, 19 nt, Homo sapiens
gaacaauucgagagacaga

SEQ ID NO: 1585101 - RNA, 19 nt, Homo sapiens
gaaagccauucccacaaag

SEQ ID NO: 1585102 - RNA, 19 nt, Homo sapiens
ggacgagcaacaacacaaa

SEQ ID NO: 1585103 - RNA, 19 nt, Homo sapiens
gggagcagcugaucaccau

SEQ ID NO: 1585104 - RNA, 19 nt, Homo sapiens
auaaagcgcuggcaggaau

SEQ ID NO: 1585105 - RNA, 19 nt, Homo sapiens
gaaagcaagcacaaaauaa

SEQ ID NO: 1585106 - RNA, 19 nt, Homo sapiens
gcaacaacacaaauucaga

SEQ ID NO: 1585107 - RNA, 19 nt, Homo sapiens
cgacauuaccgaacaccua

SEQ ID NO: 1585108 - RNA, 19 nt, Homo sapiens
gcggaaagauaaaguaagc

SEQ ID NO: 1585109 - RNA, 19 nt, Homo sapiens
guaauaaggagaccaaguc

SEQ ID NO: 1585110 - RNA, 19 nt, Homo sapiens
gauaagccacaaaugaaga

SEQ ID NO: 1585111 - RNA, 19 nt, Homo sapiens
gacauuaccgaacaccuaa

SEQ ID NO: 1585112 - RNA, 19 nt, Homo sapiens
ccacugaggucuggguugu

SEQ ID NO: 1585113 - RNA, 19 nt, Homo sapiens
ccuacgagaucaccacaga

SEQ ID NO: 1585114 - RNA, 19 nt, Homo sapiens
ccagugggagcaagucaua

SEQ ID NO: 1585115 - RNA, 19 nt, Homo sapiens
gcacacgcaccguugaguu

SEQ ID NO: 1585116 - RNA, 19 nt, Homo sapiens
gagcaacaacacaaauuca

SEQ ID NO: 1585117 - RNA, 19 nt, Homo sapiens
cagagaaaccaauaagaau

SEQ ID NO: 1585118 - RNA, 19 nt, Homo sapiens
aagauaagccacaaaugaa

SEQ ID NO: 1585119 - RNA, 19 nt, Homo sapiens
ccaagaagaaggccaagau

SEQ ID NO: 1585120 - RNA, 19 nt, Homo sapiens
ggaaagauaaaguaagcau

SEQ ID NO: 1585121 - RNA, 19 nt, Homo sapiens
gaugacgacacccucagua

SEQ ID NO: 1585122 - RNA, 19 nt, Homo sapiens
guucaaggccuuucagaag

SEQ ID NO: 1585123 - RNA, 19 nt, Homo sapiens
caagcggaaagauaaagua

SEQ ID NO: 1585124 - RNA, 19 nt, Homo sapiens
guaagcauauugucaaccu

SEQ ID NO: 1585125 - RNA, 19 nt, Homo sapiens
gcagaguuaagaccuguga

SEQ ID NO: 1585126 - RNA, 19 nt, Homo sapiens
cacacgcaccguugaguua

SEQ ID NO: 1585127 - RNA, 19 nt, Homo sapiens
uuacuuuggugucccagaa

SEQ ID NO: 1585128 - RNA, 19 nt, Homo sapiens
ucagagcgaucgauauucg

SEQ ID NO: 1585129 - RNA, 19 nt, Homo sapiens
gcacaggccccaccaagaa

SEQ ID NO: 1585130 - RNA, 19 nt, Homo sapiens
acgcgagugugcaauguuu

SEQ ID NO: 1585131 - RNA, 19 nt, Homo sapiens
gaacauccucuuccaucuc

SEQ ID NO: 1585132 - RNA, 19 nt, Homo sapiens
uaucccagcuggucacaca

SEQ ID NO: 1585133 - RNA, 19 nt, Homo sapiens
caagaagaaggccaagaug

SEQ ID NO: 1585134 - RNA, 19 nt, Homo sapiens
agccacaaaugaagagaaa

SEQ ID NO: 1585135 - RNA, 19 nt, Homo sapiens
ccgguucccugcauucguu

SEQ ID NO: 1585136 - RNA, 19 nt, Homo sapiens
gagcagcugaucaccaugu

SEQ ID NO: 1585137 - RNA, 19 nt, Homo sapiens
gguuagcuaccacccuaua

SEQ ID NO: 1585138 - RNA, 19 nt, Homo sapiens
acucagagcgaucgauauu

SEQ ID NO: 1585139 - RNA, 19 nt, Homo sapiens
ggaaucgucaugaccaaag

SEQ ID NO: 1585140 - RNA, 19 nt, Homo sapiens
caagucauagagaacaauu

SEQ ID NO: 1585141 - RNA, 19 nt, Homo sapiens
aaaacaaccuuuaccuuca

SEQ ID NO: 1585142 - RNA, 19 nt, Homo sapiens
cagagaaacgaaagccauu

SEQ ID NO: 1585143 - RNA, 19 nt, Homo sapiens
gagcaagucauagagaaca

SEQ ID NO: 1585144 - RNA, 19 nt, Homo sapiens
auucagaacgugccucuuu

SEQ ID NO: 1585145 - RNA, 19 nt, Homo sapiens
gcuaccggcugcgagagaa

SEQ ID NO: 1585146 - RNA, 19 nt, Homo sapiens
ugcaggagcuguucgacau

SEQ ID NO: 1585147 - RNA, 19 nt, Homo sapiens
ccgaacaccuaaaauagaa

SEQ ID NO: 1585148 - RNA, 19 nt, Homo sapiens
cgagcaacaacacaaauuc

SEQ ID NO: 1585149 - RNA, 19 nt, Homo sapiens
aagcggaaagauaaaguaa

SEQ ID NO: 1585150 - RNA, 19 nt, Homo sapiens
caccggagcagcagcaguu

SEQ ID NO: 1585151 - RNA, 19 nt, Homo sapiens
cgauauucgugcgguuaaa

SEQ ID NO: 1585152 - RNA, 19 nt, Homo sapiens
gaaucgucaugaccaaagg

SEQ ID NO: 1585153 - RNA, 19 nt, Homo sapiens
ucagguccuucgugcaguu

SEQ ID NO: 1585154 - RNA, 19 nt, Homo sapiens
gagaaaccaauaagaaucc

SEQ ID NO: 1585155 - RNA, 19 nt, Homo sapiens
agagaaaccaauaagaauc

SEQ ID NO: 1585156 - RNA, 19 nt, Homo sapiens
uagagaacaauucgagaga

SEQ ID NO: 1585157 - RNA, 19 nt, Homo sapiens
caggaaucgucaugaccaa

SEQ ID NO: 1585158 - RNA, 19 nt, Homo sapiens
gguaauaaggagaccaagu

SEQ ID NO: 1585159 - RNA, 19 nt, Homo sapiens
gagcagcagcaguuucuac

SEQ ID NO: 1585160 - RNA, 19 nt, Homo sapiens
agaaagcaagcacaaaaua

SEQ ID NO: 1585161 - RNA, 19 nt, Homo sapiens
acaaagugaaggaacaguu

SEQ ID NO: 1585162 - RNA, 19 nt, Homo sapiens
uguacgacauuaccgaaca

SEQ ID NO: 1585163 - RNA, 19 nt, Homo sapiens
guuagcuaccacccuauaa

SEQ ID NO: 1585164 - RNA, 19 nt, Homo sapiens
cgccaaugccgcaggaauu

SEQ ID NO: 1585165 - RNA, 19 nt, Homo sapiens
ccuccgaccaggccgauuu

SEQ ID NO: 1585166 - RNA, 19 nt, Homo sapiens
gucauggcguuugguuuau

SEQ ID NO: 1585167 - RNA, 19 nt, Homo sapiens
cuggagggcugagcaguca

SEQ ID NO: 1585168 - RNA, 19 nt, Homo sapiens
uuaccgaacaccuaaaaua

SEQ ID NO: 1585169 - RNA, 19 nt, Homo sapiens
aacugcagcuggucuggaa

SEQ ID NO: 1585170 - RNA, 19 nt, Homo sapiens
ccugaguccuggcaucaca

SEQ ID NO: 1585171 - RNA, 19 nt, Homo sapiens
aaacaccucgucaggaagu

SEQ ID NO: 1585172 - RNA, 19 nt, Homo sapiens
agaacauccucuuccaucu

SEQ ID NO: 1585173 - RNA, 19 nt, Homo sapiens
cgguagcgguggaggugaa

SEQ ID NO: 1585174 - RNA, 19 nt, Homo sapiens
uacuccaccuccuuucaaa

SEQ ID NO: 1585175 - RNA, 19 nt, Homo sapiens
gcaagucauagagaacaau

SEQ ID NO: 1585176 - RNA, 19 nt, Homo sapiens
ugaagauaagccacaaaug

SEQ ID NO: 1585177 - RNA, 19 nt, Homo sapiens
ggagguccaagcggaaaga

SEQ ID NO: 1585178 - RNA, 19 nt, Homo sapiens
gacgacacccucaguacca

SEQ ID NO: 1585179 - RNA, 19 nt, Homo sapiens
ucaaaugcaaguccaagag

SEQ ID NO: 1585180 - RNA, 19 nt, Homo sapiens
gacgagcaacaacacaaau

SEQ ID NO: 1585181 - RNA, 19 nt, Homo sapiens
gccaaugccgcaggaauuc

SEQ ID NO: 1585182 - RNA, 19 nt, Homo sapiens
ggaagaagaucaacgaaga

SEQ ID NO: 1585183 - RNA, 19 nt, Homo sapiens
gaaagggccugaagucuug

SEQ ID NO: 1585184 - RNA, 19 nt, Homo sapiens
gacaauagguuucuuacuu

SEQ ID NO: 1585185 - RNA, 19 nt, Homo sapiens
agagacaccuuacuuauaa

SEQ ID NO: 1585186 - RNA, 19 nt, Homo sapiens
gaagugcuguuuacucauu

SEQ ID NO: 1585187 - RNA, 19 nt, Homo sapiens
guagaaauguccuguauuc

SEQ ID NO: 1585188 - RNA, 19 nt, Homo sapiens
ggaggaugcuguacacauu

SEQ ID NO: 1585189 - RNA, 19 nt, Homo sapiens
ucagaaaccucaaagagaa

SEQ ID NO: 1585190 - RNA, 19 nt, Homo sapiens
ugacauggaugaaauugaa

SEQ ID NO: 1585191 - RNA, 19 nt, Homo sapiens
caaggucagugucaucuuu

SEQ ID NO: 1585192 - RNA, 19 nt, Homo sapiens
cugcauggcuguugacaua

SEQ ID NO: 1585193 - RNA, 19 nt, Homo sapiens
gacauggacuuguuuauag

SEQ ID NO: 1585194 - RNA, 19 nt, Homo sapiens
gaacaucaacaucaccuuu

SEQ ID NO: 1585195 - RNA, 19 nt, Homo sapiens
ccacaaaucacacaacaaa

SEQ ID NO: 1585196 - RNA, 19 nt, Homo sapiens
gagaugaacauucuagaaa

SEQ ID NO: 1585197 - RNA, 19 nt, Homo sapiens
ugacaacgaugacgaugaa

SEQ ID NO: 1585198 - RNA, 19 nt, Homo sapiens
uaucaggacugguuacuug

SEQ ID NO: 1585199 - RNA, 19 nt, Homo sapiens
caacaucaccuuugaggaa

SEQ ID NO: 1585200 - RNA, 19 nt, Homo sapiens
ccaaauauuuccucaucuu

SEQ ID NO: 1585201 - RNA, 19 nt, Homo sapiens
cagagaaggucuaguuugu

SEQ ID NO: 1585202 - RNA, 19 nt, Homo sapiens
cagaagugcuguuuacuca

SEQ ID NO: 1585203 - RNA, 19 nt, Homo sapiens
cggcacauuucacucauua

SEQ ID NO: 1585204 - RNA, 19 nt, Homo sapiens
ccaaccagcagaacaaaua

SEQ ID NO: 1585205 - RNA, 19 nt, Homo sapiens
gccaucacuuguucaaaua

SEQ ID NO: 1585206 - RNA, 19 nt, Homo sapiens
gccaucacuuguucaaaua

SEQ ID NO: 1585207 - RNA, 19 nt, Homo sapiens
ggauagauguuauucaacu

SEQ ID NO: 1585208 - RNA, 19 nt, Homo sapiens
ggauagauguuauucaacu

SEQ ID NO: 1585209 - RNA, 19 nt, Homo sapiens
ugaaagugaugaugaggaa

SEQ ID NO: 1585210 - RNA, 19 nt, Homo sapiens
uaacucaacuggccugcuu

SEQ ID NO: 1585211 - RNA, 19 nt, Homo sapiens
ucaggaugcuguaaacauu

SEQ ID NO: 1585212 - RNA, 19 nt, Homo sapiens
gaggagcucaggcaauaua

SEQ ID NO: 1585213 - RNA, 19 nt, Homo sapiens
gaugaacauucuagaaauc

SEQ ID NO: 1585214 - RNA, 19 nt, Homo sapiens
ugacauggacuuguuuaua

SEQ ID NO: 1585215 - RNA, 19 nt, Homo sapiens
ggacaucggugggaucaag

SEQ ID NO: 1585216 - RNA, 19 nt, Homo sapiens
ggaaugagcgacaguucaa

SEQ ID NO: 1585217 - RNA, 19 nt, Homo sapiens
uagagacaccuuacuuaua

SEQ ID NO: 1585218 - RNA, 19 nt, Homo sapiens
gcacauuucacucauuaga

SEQ ID NO: 1585219 - RNA, 19 nt, Homo sapiens
agaaacagcaguucagaaa

SEQ ID NO: 1585220 - RNA, 19 nt, Homo sapiens
gaucauccuguaaacauuu

SEQ ID NO: 1585221 - RNA, 19 nt, Homo sapiens
gggcagagaaggucuaguu

SEQ ID NO: 1585222 - RNA, 19 nt, Homo sapiens
gcacagcaccuuguccaaa

SEQ ID NO: 1585223 - RNA, 19 nt, Homo sapiens
gcagagaaggucuaguuug

SEQ ID NO: 1585224 - RNA, 19 nt, Homo sapiens
caauagguuucuuacuuug

SEQ ID NO: 1585225 - RNA, 19 nt, Homo sapiens
gaagaagaucaacgaagaa

SEQ ID NO: 1585226 - RNA, 19 nt, Homo sapiens
cugccugugucuauuauua

SEQ ID NO: 1585227 - RNA, 19 nt, Homo sapiens
gaggaugcuguacacauua

SEQ ID NO: 1585228 - RNA, 19 nt, Homo sapiens
gaagaaacagcaguucaga

SEQ ID NO: 1585229 - RNA, 19 nt, Homo sapiens
gccugugucuauuauuaua

SEQ ID NO: 1585230 - RNA, 19 nt, Homo sapiens
gaucuacauucugaaguug

SEQ ID NO: 1585231 - RNA, 19 nt, Homo sapiens
ccaaccagccucacaagaa

SEQ ID NO: 1585232 - RNA, 19 nt, Homo sapiens
caaauagccauggcccuua

SEQ ID NO: 1585233 - RNA, 19 nt, Homo sapiens
ggaggaaugugccaucacu

SEQ ID NO: 1585234 - RNA, 19 nt, Homo sapiens
aaauucagccuaaacguuu

SEQ ID NO: 1585235 - RNA, 19 nt, Homo sapiens
uugcaggacucacuggaua

SEQ ID NO: 1585236 - RNA, 19 nt, Homo sapiens
ggcaggaccuccaagaaca

SEQ ID NO: 1585237 - RNA, 19 nt, Homo sapiens
aacgagagcugacccaguu

SEQ ID NO: 1585238 - RNA, 19 nt, Homo sapiens
cgaugacgaugaagauguu

SEQ ID NO: 1585239 - RNA, 19 nt, Homo sapiens
cuggauagauguuauucaa

SEQ ID NO: 1585240 - RNA, 19 nt, Homo sapiens
cuggauagauguuauucaa

SEQ ID NO: 1585241 - RNA, 19 nt, Homo sapiens
uaaauucagccuaaacguu

SEQ ID NO: 1585242 - RNA, 19 nt, Homo sapiens
gcacaugccgggagugauc

SEQ ID NO: 1585243 - RNA, 19 nt, Homo sapiens
ugaucuacauucugaaguu

SEQ ID NO: 1585244 - RNA, 19 nt, Homo sapiens
ggaaucugcaggagucuga

SEQ ID NO: 1585245 - RNA, 19 nt, Homo sapiens
aaagucgacucaacucuca

SEQ ID NO: 1585246 - RNA, 19 nt, Homo sapiens
gaaugugccaucacuuguu

SEQ ID NO: 1585247 - RNA, 19 nt, Homo sapiens
aaguagaaauguccuguau

SEQ ID NO: 1585248 - RNA, 19 nt, Homo sapiens
gaagacaaagucaacucaa

SEQ ID NO: 1585249 - RNA, 19 nt, Homo sapiens
caaccagccucacaagaac

SEQ ID NO: 1585250 - RNA, 19 nt, Homo sapiens
uagcugcauuucuuuaguu

SEQ ID NO: 1585251 - RNA, 19 nt, Homo sapiens
acagcuagauggacaaaca

SEQ ID NO: 1585252 - RNA, 19 nt, Homo sapiens
ggaccaagaagaggaagaa

SEQ ID NO: 1585253 - RNA, 19 nt, Homo sapiens
uggcugggcucuugacaug

SEQ ID NO: 1585254 - RNA, 19 nt, Homo sapiens
ggaagacaaagucaacuca

SEQ ID NO: 1585255 - RNA, 19 nt, Homo sapiens
gagaagaaacagcaguuca

SEQ ID NO: 1585256 - RNA, 19 nt, Homo sapiens
ggacugguuacuugguuaa

SEQ ID NO: 1585257 - RNA, 19 nt, Homo sapiens
gaaguugucugaaaauguc

SEQ ID NO: 1585258 - RNA, 19 nt, Homo sapiens
gaaguguguuuuacucauu

SEQ ID NO: 1585259 - RNA, 19 nt, Homo sapiens
gaaaagaaggggaagaaga

SEQ ID NO: 1585260 - RNA, 19 nt, Homo sapiens
gaaaagaaggggaagaaga

SEQ ID NO: 1585261 - RNA, 19 nt, Homo sapiens
gcugggcucuugacaugga

SEQ ID NO: 1585262 - RNA, 19 nt, Homo sapiens
ugagguggcugagaaagug

SEQ ID NO: 1585263 - RNA, 19 nt, Homo sapiens
aauauaaaguccugguuca

SEQ ID NO: 1585264 - RNA, 19 nt, Homo sapiens
guggugacauggacuuguu

SEQ ID NO: 1585265 - RNA, 19 nt, Homo sapiens
gcagagaugaacauucuag

SEQ ID NO: 1585266 - RNA, 19 nt, Homo sapiens
ccagaugggagucauauuc

SEQ ID NO: 1585267 - RNA, 19 nt, Homo sapiens
aguagagccugaagucuug

SEQ ID NO: 1585268 - RNA, 19 nt, Homo sapiens
ggccagcccuacagaagug

SEQ ID NO: 1585269 - RNA, 19 nt, Homo sapiens
caugauaucaggacugguu

SEQ ID NO: 1585270 - RNA, 19 nt, Homo sapiens
caaagguguuacccugguu

SEQ ID NO: 1585271 - RNA, 19 nt, Homo sapiens
cacaagaacaucaacauca

SEQ ID NO: 1585272 - RNA, 19 nt, Homo sapiens
ggaagacaaagucgacuca

SEQ ID NO: 1585273 - RNA, 19 nt, Homo sapiens
ugccaucacuuguucaaau

SEQ ID NO: 1585274 - RNA, 19 nt, Homo sapiens
aggcagagaugaacauucu

SEQ ID NO: 1585275 - RNA, 19 nt, Homo sapiens
gaaaucaacgagaaauugc

SEQ ID NO: 1585276 - RNA, 19 nt, Homo sapiens
gaaguuccuuuuaugcauu

SEQ ID NO: 1585277 - RNA, 19 nt, Homo sapiens
gaagguuauucgacucucu

SEQ ID NO: 1585278 - RNA, 19 nt, Homo sapiens
caacgaugacgaugaagau

SEQ ID NO: 1585279 - RNA, 19 nt, Homo sapiens
gcgagaaggcagagaugaa

SEQ ID NO: 1585280 - RNA, 19 nt, Homo sapiens
auucugaaguugucugaaa

SEQ ID NO: 1585281 - RNA, 19 nt, Homo sapiens
agugucaucuuuguguuua

SEQ ID NO: 1585282 - RNA, 19 nt, Homo sapiens
gcacagacguuuaacagua

SEQ ID NO: 1585283 - RNA, 19 nt, Homo sapiens
gaagaaggcugauaucaca

SEQ ID NO: 1585284 - RNA, 19 nt, Homo sapiens
gagcaaagacuuaaacuaa

SEQ ID NO: 1585285 - RNA, 19 nt, Homo sapiens
gaaagacagugacgaagaa

SEQ ID NO: 1585286 - RNA, 19 nt, Homo sapiens
caacaggccugauggaauu

SEQ ID NO: 1585287 - RNA, 19 nt, Homo sapiens
gaacaacucuaugaaaugu

SEQ ID NO: 1585288 - RNA, 19 nt, Homo sapiens
gcucauggauagccaaaua

SEQ ID NO: 1585289 - RNA, 19 nt, Homo sapiens
gcaaagacuuaaacuaaug

SEQ ID NO: 1585290 - RNA, 19 nt, Homo sapiens
gaaagcagcugcaaaauau

SEQ ID NO: 1585291 - RNA, 19 nt, Homo sapiens
ggaauuugcccaccacuua

SEQ ID NO: 1585292 - RNA, 19 nt, Homo sapiens
gcagacaccuauauuaugu

SEQ ID NO: 1585293 - RNA, 19 nt, Homo sapiens
gaacaagaacugcauuuga

SEQ ID NO: 1585294 - RNA, 19 nt, Homo sapiens
gaacaggacagaauauuau

SEQ ID NO: 1585295 - RNA, 19 nt, Homo sapiens
gaaaggugguccggaauuu

SEQ ID NO: 1585296 - RNA, 19 nt, Homo sapiens
guacagcaguuccaugaaa

SEQ ID NO: 1585297 - RNA, 19 nt, Homo sapiens
gaacaccagcuccuuuaua

SEQ ID NO: 1585298 - RNA, 19 nt, Homo sapiens
cgagaaagcugccuugauc

SEQ ID NO: 1585299 - RNA, 19 nt, Homo sapiens
gugguugacugauagauua

SEQ ID NO: 1585300 - RNA, 19 nt, Homo sapiens
ugucuaagcugucaaggua

SEQ ID NO: 1585301 - RNA, 19 nt, Homo sapiens
acacuagacucaccgaaua

SEQ ID NO: 1585302 - RNA, 19 nt, Homo sapiens
caauauaccuuugcuaugu

SEQ ID NO: 1585303 - RNA, 19 nt, Homo sapiens
gaagaggacuugugcaaac

SEQ ID NO: 1585304 - RNA, 19 nt, Homo sapiens
ugaagaaaguggucagaaa

SEQ ID NO: 1585305 - RNA, 19 nt, Homo sapiens
cagaagaggugaagaaagu

SEQ ID NO: 1585306 - RNA, 19 nt, Homo sapiens
gcaaacagccaaauagaau

SEQ ID NO: 1585307 - RNA, 19 nt, Homo sapiens
gcaaggaacaacucuauga

SEQ ID NO: 1585308 - RNA, 19 nt, Homo sapiens
ggacauaggagaugagaau

SEQ ID NO: 1585309 - RNA, 19 nt, Homo sapiens
ugaagacgcucaucaagau

SEQ ID NO: 1585310 - RNA, 19 nt, Homo sapiens
guggaugccuucuuuauau

SEQ ID NO: 1585311 - RNA, 19 nt, Homo sapiens
cacaaacacuugcaagaaa

SEQ ID NO: 1585312 - RNA, 19 nt, Homo sapiens
cuagaaagcuggaagagau

SEQ ID NO: 1585313 - RNA, 19 nt, Homo sapiens
gcaacgcaguucggaguua

SEQ ID NO: 1585314 - RNA, 19 nt, Homo sapiens
caaaucagcugaauuacac

SEQ ID NO: 1585315 - RNA, 19 nt, Homo sapiens
ccacagauuccuaacauuu

SEQ ID NO: 1585316 - RNA, 19 nt, Homo sapiens
gauaagccauuucagauac

SEQ ID NO: 1585317 - RNA, 19 nt, Homo sapiens
uagccaggauucugacuua

SEQ ID NO: 1585318 - RNA, 19 nt, Homo sapiens
caacagucuucccaaugua

SEQ ID NO: 1585319 - RNA, 19 nt, Homo sapiens
agaaagauuugaggagaua

SEQ ID NO: 1585320 - RNA, 19 nt, Homo sapiens
gaaagaaaauuccccaaau

SEQ ID NO: 1585321 - RNA, 19 nt, Homo sapiens
ccacaggucaaucauauaa

SEQ ID NO: 1585322 - RNA, 19 nt, Homo sapiens
ggccacaggucaaucauau

SEQ ID NO: 1585323 - RNA, 19 nt, Homo sapiens
ccgcaagacuccugggaua

SEQ ID NO: 1585324 - RNA, 19 nt, Homo sapiens
guaaagaugcagaucguuu

SEQ ID NO: 1585325 - RNA, 19 nt, Homo sapiens
aaagaagucugaaccacaa

SEQ ID NO: 1585326 - RNA, 19 nt, Homo sapiens
gauaaaccagcacauauga

SEQ ID NO: 1585327 - RNA, 19 nt, Homo sapiens
ugggaagggugauauuaua

SEQ ID NO: 1585328 - RNA, 19 nt, Homo sapiens
aacaagaacugcauuugaa

SEQ ID NO: 1585329 - RNA, 19 nt, Homo sapiens
uaaagaaggagauacugua

SEQ ID NO: 1585330 - RNA, 19 nt, Homo sapiens
gaagucaguugcucccaau

SEQ ID NO: 1585331 - RNA, 19 nt, Homo sapiens
uaacgcagaugaacaagca

SEQ ID NO: 1585332 - RNA, 19 nt, Homo sapiens
ccaacagucuucccaaugu

SEQ ID NO: 1585333 - RNA, 19 nt, Homo sapiens
aagcugccuugaucaauua

SEQ ID NO: 1585334 - RNA, 19 nt, Homo sapiens
cccagaaacugaauccuaa

SEQ ID NO: 1585335 - RNA, 19 nt, Homo sapiens
gguuguauguucuuuaaug

SEQ ID NO: 1585336 - RNA, 19 nt, Homo sapiens
gaucaaugguacagcaguu

SEQ ID NO: 1585337 - RNA, 19 nt, Homo sapiens
caauguagcucuuccaaaa

SEQ ID NO: 1585338 - RNA, 19 nt, Homo sapiens
ggaggcagcagaagcuuaa

SEQ ID NO: 1585339 - RNA, 19 nt, Homo sapiens
uaaaccaguuccugcaauu

SEQ ID NO: 1585340 - RNA, 19 nt, Homo sapiens
aacaccagcuccuuuauaa

SEQ ID NO: 1585341 - RNA, 19 nt, Homo sapiens
gcaaagcaccaaacucugu

SEQ ID NO: 1585342 - RNA, 19 nt, Homo sapiens
gcuagaggccugugucaaa

SEQ ID NO: 1585343 - RNA, 19 nt, Homo sapiens
gcagaagcuuaacaaacaa

SEQ ID NO: 1585344 - RNA, 19 nt, Homo sapiens
ugaacaggacagaauauua

SEQ ID NO: 1585345 - RNA, 19 nt, Homo sapiens
gagcaaagagacaguguug

SEQ ID NO: 1585346 - RNA, 19 nt, Homo sapiens
aaaguaagccugaauguag

SEQ ID NO: 1585347 - RNA, 19 nt, Homo sapiens
aaacuaauggccagugaua

SEQ ID NO: 1585348 - RNA, 19 nt, Homo sapiens
agaaggagauacuguaauc

SEQ ID NO: 1585349 - RNA, 19 nt, Homo sapiens
ugaauuacaccgaauggua

SEQ ID NO: 1585350 - RNA, 19 nt, Homo sapiens
gaguugcggucuucaguga

SEQ ID NO: 1585351 - RNA, 19 nt, Homo sapiens
ucaucaagauugugaagaa

SEQ ID NO: 1585352 - RNA, 19 nt, Homo sapiens
aaagcugccuugaucaauu

SEQ ID NO: 1585353 - RNA, 19 nt, Homo sapiens
gugguuguauguucuuuaa

SEQ ID NO: 1585354 - RNA, 19 nt, Homo sapiens
ggauaaaccagcacauaug

SEQ ID NO: 1585355 - RNA, 19 nt, Homo sapiens
gaacaagcagcccagauca

SEQ ID NO: 1585356 - RNA, 19 nt, Homo sapiens
ggauaacgcagaugaacaa

SEQ ID NO: 1585357 - RNA, 19 nt, Homo sapiens
gagcaaggaacaacucuau

SEQ ID NO: 1585358 - RNA, 19 nt, Homo sapiens
gugcggaguuugccagaaa

SEQ ID NO: 1585359 - RNA, 19 nt, Homo sapiens
gagcaacaguaccauucaa

SEQ ID NO: 1585360 - RNA, 19 nt, Homo sapiens
ucagaaacaugguauggau

SEQ ID NO: 1585361 - RNA, 19 nt, Homo sapiens
ggaacaacucuaugaaaug

SEQ ID NO: 1585362 - RNA, 19 nt, Homo sapiens
ggacuucagggcauuacua

SEQ ID NO: 1585363 - RNA, 19 nt, Homo sapiens
gaaaaugucucgagaaagc

SEQ ID NO: 1585364 - RNA, 19 nt, Homo sapiens
cuccaaaucagcugaauua

SEQ ID NO: 1585365 - RNA, 19 nt, Homo sapiens
ucacacagcuuugcagaag

SEQ ID NO: 1585366 - RNA, 19 nt, Homo sapiens
uggaaggcguguugucuaa

SEQ ID NO: 1585367 - RNA, 19 nt, Homo sapiens
ccaaauagaauggcccuaa

SEQ ID NO: 1585368 - RNA, 19 nt, Homo sapiens
gcaaagagacaguguugag

SEQ ID NO: 1585369 - RNA, 19 nt, Homo sapiens
ucuaauagcuccaaaucag

SEQ ID NO: 1585370 - RNA, 19 nt, Homo sapiens
ccuuagagauugucauaau

SEQ ID NO: 1585371 - RNA, 19 nt, Homo sapiens
guguugagcucauggauag

SEQ ID NO: 1585372 - RNA, 19 nt, Homo sapiens
cuacagggacuuucgauug

SEQ ID NO: 1585373 - RNA, 19 nt, Homo sapiens
uagaacaccagcuccuuua

SEQ ID NO: 1585374 - RNA, 19 nt, Homo sapiens
caaauagaauggcccuaag

SEQ ID NO: 1585375 - RNA, 19 nt, Homo sapiens
gcacuggccagaacaggaa

SEQ ID NO: 1585376 - RNA, 19 nt, Homo sapiens
agcagaagcuuaacaaaca

SEQ ID NO: 1585377 - RNA, 19 nt, Homo sapiens
cuucguggaugccuucuuu

SEQ ID NO: 1585378 - RNA, 19 nt, Homo sapiens
gaauaucgccaacagucuu

SEQ ID NO: 1585379 - RNA, 19 nt, Homo sapiens
gcaacaggccugauggaau

SEQ ID NO: 1585380 - RNA, 19 nt, Homo sapiens
gaacugggaagggugauau

SEQ ID NO: 1585381 - RNA, 19 nt, Homo sapiens
aggaacaacucuaugaaau

SEQ ID NO: 1585382 - RNA, 19 nt, Homo sapiens
aaacauagcuggauuaaga

SEQ ID NO: 1585383 - RNA, 19 nt, Homo sapiens
ggacaaaguuaacagcuua

SEQ ID NO: 1585384 - RNA, 19 nt, Homo sapiens
gaaagaaagucaaucugua

SEQ ID NO: 1585385 - RNA, 19 nt, Homo sapiens
ggaaugaccuuuacaacuu

SEQ ID NO: 1585386 - RNA, 19 nt, Homo sapiens
gaggaugucuuuauucuaa

SEQ ID NO: 1585387 - RNA, 19 nt, Homo sapiens
gaacaucucucgugucaca

SEQ ID NO: 1585388 - RNA, 19 nt, Homo sapiens
gcucaaagaugacagauug

SEQ ID NO: 1585389 - RNA, 19 nt, Homo sapiens
gaaauaagcuagggaaaca

SEQ ID NO: 1585390 - RNA, 19 nt, Homo sapiens
gaacaaaucuagcuaacag

SEQ ID NO: 1585391 - RNA, 19 nt, Homo sapiens
gcaugcauuucguuuauua

SEQ ID NO: 1585392 - RNA, 19 nt, Homo sapiens
gaacagaugcaaucaguga

SEQ ID NO: 1585393 - RNA, 19 nt, Homo sapiens
gacaugagaaguaugauua

SEQ ID NO: 1585394 - RNA, 19 nt, Homo sapiens
gaaugaccuuuacaacuuu

SEQ ID NO: 1585395 - RNA, 19 nt, Homo sapiens
gaagacaggacaaaguuaa

SEQ ID NO: 1585396 - RNA, 19 nt, Homo sapiens
gaacacuauuccuauaaga

SEQ ID NO: 1585397 - RNA, 19 nt, Homo sapiens
agaaagcguuguuaaugua

SEQ ID NO: 1585398 - RNA, 19 nt, Homo sapiens
gcauauauguccuacuuca

SEQ ID NO: 1585399 - RNA, 19 nt, Homo sapiens
gugcauauauguccuacuu

SEQ ID NO: 1585400 - RNA, 19 nt, Homo sapiens
caguaaagacucaguauaa

SEQ ID NO: 1585401 - RNA, 19 nt, Homo sapiens
gauaggagaugaaaaguug

SEQ ID NO: 1585402 - RNA, 19 nt, Homo sapiens
caagaaaucuggaaaacuu

SEQ ID NO: 1585403 - RNA, 19 nt, Homo sapiens
gcaccagcaucccuacuug

SEQ ID NO: 1585404 - RNA, 19 nt, Homo sapiens
gcaguaaagacucaguaua

SEQ ID NO: 1585405 - RNA, 19 nt, Homo sapiens
ggaagacaggacaaaguua

SEQ ID NO: 1585406 - RNA, 19 nt, Homo sapiens
aaguugagcuuaaugcuuu

SEQ ID NO: 1585407 - RNA, 19 nt, Homo sapiens
ggagacaugagaaguauga

SEQ ID NO: 1585408 - RNA, 19 nt, Homo sapiens
ggaggcagcaucacuuauu

SEQ ID NO: 1585409 - RNA, 19 nt, Homo sapiens
ggaguuaauuauagaaugg

SEQ ID NO: 1585410 - RNA, 19 nt, Homo sapiens
cagaagagcuaacaauugc

SEQ ID NO: 1585411 - RNA, 19 nt, Homo sapiens
ucagugggcuuuaaaauuu

SEQ ID NO: 1585412 - RNA, 19 nt, Homo sapiens
caaggaauguguagcagau

SEQ ID NO: 1585413 - RNA, 19 nt, Homo sapiens
gugcaugcauuucguuuau

SEQ ID NO: 1585414 - RNA, 19 nt, Homo sapiens
gcaaacauagcuggauuaa

SEQ ID NO: 1585415 - RNA, 19 nt, Homo sapiens
aaacacgucucaccacugu

SEQ ID NO: 1585416 - RNA, 19 nt, Homo sapiens
guauaggaauucccaugaa

SEQ ID NO: 1585417 - RNA, 19 nt, Homo sapiens
gcuagaaaucuguggguua

SEQ ID NO: 1585418 - RNA, 19 nt, Homo sapiens
gcauuucguuuauuagcaa

SEQ ID NO: 1585419 - RNA, 19 nt, Homo sapiens
gaggcagcaucacuuauug

SEQ ID NO: 1585420 - RNA, 19 nt, Homo sapiens
gaaagcguuguuaauguaa

SEQ ID NO: 1585421 - RNA, 19 nt, Homo sapiens
cagaacagaugcaaucagu

SEQ ID NO: 1585422 - RNA, 19 nt, Homo sapiens
gaggcucagugaaguauau

SEQ ID NO: 1585423 - RNA, 19 nt, Homo sapiens
uagaauggguuauuguugu

SEQ ID NO: 1585424 - RNA, 19 nt, Homo sapiens
aaagaaagcguuguuaaug

SEQ ID NO: 1585425 - RNA, 19 nt, Homo sapiens
gcuaacaauugcuggaaug

SEQ ID NO: 1585426 - RNA, 19 nt, Homo sapiens
cuagaaaucuguggguuau

SEQ ID NO: 1585427 - RNA, 19 nt, Homo sapiens
guagagcuguuccuuugga

SEQ ID NO: 1585428 - RNA, 19 nt, Homo sapiens
uagcaaacauagcuggauu

SEQ ID NO: 1585429 - RNA, 19 nt, Homo sapiens
gggaggaugucuuuauucu

SEQ ID NO: 1585430 - RNA, 19 nt, Homo sapiens
uaauugguaucccuccuaa

SEQ ID NO: 1585431 - RNA, 19 nt, Homo sapiens
aagaaagcguuguuaaugu

SEQ ID NO: 1585432 - RNA, 19 nt, Homo sapiens
auucacagcuuccucauga

SEQ ID NO: 1585433 - RNA, 19 nt, Homo sapiens
gcauuguucuuuaguugga

SEQ ID NO: 1585434 - RNA, 19 nt, Homo sapiens
gcucauuuggguaaacuua

SEQ ID NO: 1585435 - RNA, 19 nt, Homo sapiens
gaugaaacaauauccaaug

SEQ ID NO: 1585436 - RNA, 19 nt, Homo sapiens
gcaagcacgucgcguuugg

SEQ ID NO: 1585437 - RNA, 19 nt, Homo sapiens
gaacagauuggagauagga

SEQ ID NO: 1585438 - RNA, 19 nt, Homo sapiens
guggaggaguuaauuauag

SEQ ID NO: 1585439 - RNA, 19 nt, Homo sapiens
gagcaagcacgucgcguuu

SEQ ID NO: 1585440 - RNA, 19 nt, Homo sapiens
cgaaagaaagucaaucugu

SEQ ID NO: 1585441 - RNA, 19 nt, Homo sapiens
gugaaugaacuagguaaua

SEQ ID NO: 1585442 - RNA, 19 nt, Homo sapiens
ggaugucuuuauucuaaug

SEQ ID NO: 1585443 - RNA, 19 nt, Homo sapiens
gauuggagauaggagauga

SEQ ID NO: 1585444 - RNA, 19 nt, Homo sapiens
cucaugaaguuacagauuu

SEQ ID NO: 1585445 - RNA, 19 nt, Homo sapiens
gugguaagcuagguucauu

SEQ ID NO: 1585446 - RNA, 19 nt, Homo sapiens
uauauugacugauguuugg

SEQ ID NO: 1585447 - RNA, 19 nt, Homo sapiens
aauccaaaguugagcuuaa

SEQ ID NO: 1585448 - RNA, 19 nt, Homo sapiens
ucagaagagcuaacaauug

SEQ ID NO: 1585449 - RNA, 19 nt, Homo sapiens
gaaugcagaggcucaguga

SEQ ID NO: 1585450 - RNA, 19 nt, Homo sapiens
gcaggugcaucaguuacuu

SEQ ID NO: 1585451 - RNA, 19 nt, Homo sapiens
ugguaucccuccuaacuuu

SEQ ID NO: 1585452 - RNA, 19 nt, Homo sapiens
aaggaaagcucuccaacca

SEQ ID NO: 1585453 - RNA, 19 nt, Homo sapiens
ggaagugcaugcauuucgu

SEQ ID NO: 1585454 - RNA, 19 nt, Homo sapiens
gcagaggcucagugaagua

SEQ ID NO: 1585455 - RNA, 19 nt, Homo sapiens
cuguagagcuguuccuuug

SEQ ID NO: 1585456 - RNA, 19 nt, Homo sapiens
ccagagcucauuuggguaa

SEQ ID NO: 1585457 - RNA, 19 nt, Homo sapiens
ggaaugugacccugaagga

SEQ ID NO: 1585458 - RNA, 19 nt, Homo sapiens
ugagauauuugggcuuuau

SEQ ID NO: 1585459 - RNA, 19 nt, Homo sapiens
aaacagucauuuacgaaag

SEQ ID NO: 1585460 - RNA, 19 nt, Homo sapiens
gaaaaucaguuagaaccaa

SEQ ID NO: 1585461 - RNA, 19 nt, Homo sapiens
aaaucuagcuaacagugaa

SEQ ID NO: 1585462 - RNA, 19 nt, Homo sapiens
guuaacaucuguagcuuuu

SEQ ID NO: 1585463 - RNA, 19 nt, Homo sapiens
ucugugaguugaggacuua

SEQ ID NO: 1585464 - RNA, 19 nt, Homo sapiens
gcucuuaauucugugaguu

SEQ ID NO: 1585465 - RNA, 19 nt, Homo sapiens
guaaagcuguaugccauca

SEQ ID NO: 1585466 - RNA, 19 nt, Homo sapiens
cuuggaagcuggcaggauu

SEQ ID NO: 1585467 - RNA, 19 nt, Homo sapiens
ugacagaacagaugcaauc

SEQ ID NO: 1585468 - RNA, 19 nt, Homo sapiens
uagggcagcucuuugugaa

SEQ ID NO: 1585469 - RNA, 19 nt, Homo sapiens
uuacuucucuggacugauc

SEQ ID NO: 1585470 - RNA, 19 nt, Homo sapiens
ucaguuagaaccaauguau

SEQ ID NO: 1585471 - RNA, 19 nt, Homo sapiens
ucugucaacucucucauug

SEQ ID NO: 1585472 - RNA, 19 nt, Homo sapiens
ucucuggacugauccuauu

SEQ ID NO: 1585473 - RNA, 19 nt, Homo sapiens
cgugagauauuugggcuuu

SEQ ID NO: 1585474 - RNA, 19 nt, Homo sapiens
aagucaaucuguauccuaa

SEQ ID NO: 1585475 - RNA, 19 nt, Homo sapiens
ggagaaaggggauugaaaa

SEQ ID NO: 1585476 - RNA, 19 nt, Homo sapiens
ucagugaaguauauaugug

SEQ ID NO: 1585477 - RNA, 19 nt, Homo sapiens
gaggcauuguucuuuaguu

SEQ ID NO: 1585478 - RNA, 19 nt, Homo sapiens
gaauggguuauuguuguua

SEQ ID NO: 1585479 - RNA, 19 nt, Homo sapiens
uuaaugggauugucuuucu

SEQ ID NO: 1585480 - RNA, 19 nt, Homo sapiens
uaucagagugcauauaugu

SEQ ID NO: 1585481 - RNA, 19 nt, Homo sapiens
caugaauuaugacuucuca

SEQ ID NO: 1585482 - RNA, 19 nt, Homo sapiens
gggcugggcuccugucauu

SEQ ID NO: 1585483 - RNA, 19 nt, Homo sapiens
cauugagcaucauuucuua

SEQ ID NO: 1585484 - RNA, 19 nt, Homo sapiens
gaaguagaggugcaaauga

SEQ ID NO: 1585485 - RNA, 19 nt, Homo sapiens
gcaucgggaucuucuuuga

SEQ ID NO: 1585486 - RNA, 19 nt, Homo sapiens
ggcaggagcugaacaagag

SEQ ID NO: 1585487 - RNA, 19 nt, Homo sapiens
ggauguaacuccaaaauca

SEQ ID NO: 1585488 - RNA, 19 nt, Homo sapiens
gagcacggaucaccuacug

SEQ ID NO: 1585489 - RNA, 19 nt, Homo sapiens
ggaaguagaggugcaaaug

SEQ ID NO: 1585490 - RNA, 19 nt, Homo sapiens
gcauugagcaucauuucuu

SEQ ID NO: 1585491 - RNA, 19 nt, Homo sapiens
ccaugucacucaauaagga

SEQ ID NO: 1585492 - RNA, 19 nt, Homo sapiens
ggaagcaggcagugucuug

SEQ ID NO: 1585493 - RNA, 19 nt, Homo sapiens
gcugagagacaauggaaga

SEQ ID NO: 1585494 - RNA, 19 nt, Homo sapiens
gaugcuuccugccagauuc

SEQ ID NO: 1585495 - RNA, 19 nt, Homo sapiens
gcucccaccucguuaaagg

SEQ ID NO: 1585496 - RNA, 19 nt, Homo sapiens
aaaggugauuucccucuca

SEQ ID NO: 1585497 - RNA, 19 nt, Homo sapiens
ccucagagccugcuuugca

SEQ ID NO: 1585498 - RNA, 19 nt, Homo sapiens
caagagccuucaggagugu

SEQ ID NO: 1585499 - RNA, 19 nt, Homo sapiens
cagaagcccaggucuccua

SEQ ID NO: 1585500 - RNA, 19 nt, Homo sapiens
ucuuagagcuggaccacau

SEQ ID NO: 1585501 - RNA, 19 nt, Homo sapiens
ucagagcacggaucaccua

SEQ ID NO: 1585502 - RNA, 19 nt, Homo sapiens
gggcauugagcaucauuuc

SEQ ID NO: 1585503 - RNA, 19 nt, Homo sapiens
cucugaagcucaaggagaa

SEQ ID NO: 1585504 - RNA, 19 nt, Homo sapiens
ccuggcagaugaucaugau

SEQ ID NO: 1585505 - RNA, 19 nt, Homo sapiens
cggcaucgggaucuucuuu

SEQ ID NO: 1585506 - RNA, 19 nt, Homo sapiens
ccauguaggcucuguccuu

SEQ ID NO: 1585507 - RNA, 19 nt, Homo sapiens
aaguagaggugcaaaugag

SEQ ID NO: 1585508 - RNA, 19 nt, Homo sapiens
cggcugacgccauccauga

SEQ ID NO: 1585509 - RNA, 19 nt, Homo sapiens
ggcaugcucccaccucguu

SEQ ID NO: 1585510 - RNA, 19 nt, Homo sapiens
ggaugcuuccugccagauu

SEQ ID NO: 1585511 - RNA, 19 nt, Homo sapiens
ggcagaugaucaugauguc

SEQ ID NO: 1585512 - RNA, 19 nt, Homo sapiens
gcgcauguccuugaacagu

SEQ ID NO: 1585513 - RNA, 19 nt, Homo sapiens
gcaugcucccaccucguua

SEQ ID NO: 1585514 - RNA, 19 nt, Homo sapiens
uguucuaccuccucauuca

SEQ ID NO: 1585515 - RNA, 19 nt, Homo sapiens
cuacgcagguuugaguaca

SEQ ID NO: 1585516 - RNA, 19 nt, Homo sapiens
ccacgcacaccugagcuuu

SEQ ID NO: 1585517 - RNA, 19 nt, Homo sapiens
ggcccaggcugagagacaa

SEQ ID NO: 1585518 - RNA, 19 nt, Homo sapiens
gggcuggaauacccuucug

SEQ ID NO: 1585519 - RNA, 19 nt, Homo sapiens
ccagugauccaggugaguu

SEQ ID NO: 1585520 - RNA, 19 nt, Homo sapiens
ccugcagccuggcaucuuc

SEQ ID NO: 1585521 - RNA, 19 nt, Homo sapiens
uggcagaugaucaugaugu

SEQ ID NO: 1585522 - RNA, 19 nt, Homo sapiens
gagccugcuuugcaucacu

SEQ ID NO: 1585523 - RNA, 19 nt, Homo sapiens
ugaguucuguguggaugug

SEQ ID NO: 1585524 - RNA, 19 nt, Homo sapiens
ggacggcaucgggaucuuc

SEQ ID NO: 1585525 - RNA, 19 nt, Homo sapiens
gagcauagcauuuagauua

SEQ ID NO: 1585526 - RNA, 19 nt, Homo sapiens
guagaaagcuugccaaaga

SEQ ID NO: 1585527 - RNA, 19 nt, Homo sapiens
gcagcuggaugguuuaaua

SEQ ID NO: 1585528 - RNA, 19 nt, Homo sapiens
gagaugaugucuugauaaa

SEQ ID NO: 1585529 - RNA, 19 nt, Homo sapiens
caaaugaucuugaaugagu

SEQ ID NO: 1585530 - RNA, 19 nt, Homo sapiens
ugaacaagaugguauagua

SEQ ID NO: 1585531 - RNA, 19 nt, Homo sapiens
gaauccagcaugaauauua

SEQ ID NO: 1585532 - RNA, 19 nt, Homo sapiens
guauguaucugugcaaaua

SEQ ID NO: 1585533 - RNA, 19 nt, Homo sapiens
gaaaaugacuguagguaaa

SEQ ID NO: 1585534 - RNA, 19 nt, Homo sapiens
gaaagaauccagcaugaau

SEQ ID NO: 1585535 - RNA, 19 nt, Homo sapiens
ggucagaggaucuaacaua

SEQ ID NO: 1585536 - RNA, 19 nt, Homo sapiens
aaaguuagcuucacaccuu

SEQ ID NO: 1585537 - RNA, 19 nt, Homo sapiens
gaaaauaucugucaaacca

SEQ ID NO: 1585538 - RNA, 19 nt, Homo sapiens
guaaguacuucugugguua

SEQ ID NO: 1585539 - RNA, 19 nt, Homo sapiens
caucuaaggugacuaacaa

SEQ ID NO: 1585540 - RNA, 19 nt, Homo sapiens
cagcgggucugucaguuua

SEQ ID NO: 1585541 - RNA, 19 nt, Homo sapiens
cgaaggagcauagcauuua

SEQ ID NO: 1585542 - RNA, 19 nt, Homo sapiens
ugaccuagcuucugcaaga

SEQ ID NO: 1585543 - RNA, 19 nt, Homo sapiens
guacuucugugguuaaugu

SEQ ID NO: 1585544 - RNA, 19 nt, Homo sapiens
gauguacacuugucauguu

SEQ ID NO: 1585545 - RNA, 19 nt, Homo sapiens
ucuaauaucuuuccaguuc

SEQ ID NO: 1585546 - RNA, 19 nt, Homo sapiens
gaauagagccauguucauu

SEQ ID NO: 1585547 - RNA, 19 nt, Homo sapiens
cuacugauauucacaucua

SEQ ID NO: 1585548 - RNA, 19 nt, Homo sapiens
gaacuuggacagcagguuu

SEQ ID NO: 1585549 - RNA, 19 nt, Homo sapiens
agacuaagcugagaaacuu

SEQ ID NO: 1585550 - RNA, 19 nt, Homo sapiens
gcuguaacuucuuguauau

SEQ ID NO: 1585551 - RNA, 19 nt, Homo sapiens
ccaaagauggugaauacua

SEQ ID NO: 1585552 - RNA, 19 nt, Homo sapiens
uauaguaccuucagaaugg

SEQ ID NO: 1585553 - RNA, 19 nt, Homo sapiens
gaacaacuggcuaucaaau

SEQ ID NO: 1585554 - RNA, 19 nt, Homo sapiens
ggaaacaguagcacuuuga

SEQ ID NO: 1585555 - RNA, 19 nt, Homo sapiens
guaucgagaugaugucuug

SEQ ID NO: 1585556 - RNA, 19 nt, Homo sapiens
gaugacgcauuaauguaaa

SEQ ID NO: 1585557 - RNA, 19 nt, Homo sapiens
ggauauuucuugucuuaca

SEQ ID NO: 1585558 - RNA, 19 nt, Homo sapiens
aaauuuggcuuuccuagga

SEQ ID NO: 1585559 - RNA, 19 nt, Homo sapiens
gaccuucccuuuauauauc

SEQ ID NO: 1585560 - RNA, 19 nt, Homo sapiens
gaaggagcauagcauuuag

SEQ ID NO: 1585561 - RNA, 19 nt, Homo sapiens
gguagggccucaagaaauc

SEQ ID NO: 1585562 - RNA, 19 nt, Homo sapiens
aggaguacauccaaauaua

SEQ ID NO: 1585563 - RNA, 19 nt, Homo sapiens
ggagaagaauggcgauuac

SEQ ID NO: 1585564 - RNA, 19 nt, Homo sapiens
acagugacauuaagauuug

SEQ ID NO: 1585565 - RNA, 19 nt, Homo sapiens
agggauauuucuugucuua

SEQ ID NO: 1585566 - RNA, 19 nt, Homo sapiens
gauguaaacucaugcuuuu

SEQ ID NO: 1585567 - RNA, 19 nt, Homo sapiens
ggacaauacagaagacuau

SEQ ID NO: 1585568 - RNA, 19 nt, Homo sapiens
gaagaucucaucaguugga

SEQ ID NO: 1585569 - RNA, 19 nt, Homo sapiens
gugagaagguggcggugua

SEQ ID NO: 1585570 - RNA, 19 nt, Homo sapiens
ggaccucaguuaucuaucu

SEQ ID NO: 1585571 - RNA, 19 nt, Homo sapiens
acaaaggccuuaugaacug

SEQ ID NO: 1585572 - RNA, 19 nt, Homo sapiens
gaauggcugucuucugugu

SEQ ID NO: 1585573 - RNA, 19 nt, Homo sapiens
agaagcugaugacgcauua

SEQ ID NO: 1585574 - RNA, 19 nt, Homo sapiens
uagaacaacuggcuaucaa

SEQ ID NO: 1585575 - RNA, 19 nt, Homo sapiens
caaagauggugaauacuac

SEQ ID NO: 1585576 - RNA, 19 nt, Homo sapiens
uugaauggcuucuaaacaa

SEQ ID NO: 1585577 - RNA, 19 nt, Homo sapiens
gaaggaaacaauuaaugug

SEQ ID NO: 1585578 - RNA, 19 nt, Homo sapiens
ucaguacgauguaaacuca

SEQ ID NO: 1585579 - RNA, 19 nt, Homo sapiens
gauuugugcucuaggagaa

SEQ ID NO: 1585580 - RNA, 19 nt, Homo sapiens
gaauacuacugguguugga

SEQ ID NO: 1585581 - RNA, 19 nt, Homo sapiens
uggauuagauucuguaaag

SEQ ID NO: 1585582 - RNA, 19 nt, Homo sapiens
uaacuucggcuuugaccua

SEQ ID NO: 1585583 - RNA, 19 nt, Homo sapiens
cgguauaaaugucaugaaa

SEQ ID NO: 1585584 - RNA, 19 nt, Homo sapiens
ggaguacauccaaauauau

SEQ ID NO: 1585585 - RNA, 19 nt, Homo sapiens
gaauggcgauuacacaaaa

SEQ ID NO: 1585586 - RNA, 19 nt, Homo sapiens
uuuaauggcccuacugaua

SEQ ID NO: 1585587 - RNA, 19 nt, Homo sapiens
uaaggaguacauccaaaua

SEQ ID NO: 1585588 - RNA, 19 nt, Homo sapiens
uaagauuugugcucuagga

SEQ ID NO: 1585589 - RNA, 19 nt, Homo sapiens
gaagaauggcgauuacaca

SEQ ID NO: 1585590 - RNA, 19 nt, Homo sapiens
uaauggcccuacugauauu

SEQ ID NO: 1585591 - RNA, 19 nt, Homo sapiens
ucgagaugaugucuugaua

SEQ ID NO: 1585592 - RNA, 19 nt, Homo sapiens
guucagugguucuuggaaa

SEQ ID NO: 1585593 - RNA, 19 nt, Homo sapiens
aaguggagauggauguaua

SEQ ID NO: 1585594 - RNA, 19 nt, Homo sapiens
aaagaacucgguauaaaug

SEQ ID NO: 1585595 - RNA, 19 nt, Homo sapiens
ggagauuccugaccagaac

SEQ ID NO: 1585596 - RNA, 19 nt, Homo sapiens
ggaaagaauccagcaugaa

SEQ ID NO: 1585597 - RNA, 19 nt, Homo sapiens
ccagggauauuucuugucu

SEQ ID NO: 1585598 - RNA, 19 nt, Homo sapiens
uuucugaccuucccuuuau

SEQ ID NO: 1585599 - RNA, 19 nt, Homo sapiens
gggcagaacaagaccauga

SEQ ID NO: 1585600 - RNA, 19 nt, Homo sapiens
guacacuugucauguuuua

SEQ ID NO: 1585601 - RNA, 19 nt, Homo sapiens
gaacaaugaaaguuagcuu

SEQ ID NO: 1585602 - RNA, 19 nt, Homo sapiens
caaaccauuucugucagua

SEQ ID NO: 1585603 - RNA, 19 nt, Homo sapiens
gaaacaguagcacuuugaa

SEQ ID NO: 1585604 - RNA, 19 nt, Homo sapiens
gauuacgcuuggcuucuuu

SEQ ID NO: 1585605 - RNA, 19 nt, Homo sapiens
gaauggcuucuaaacaauu

SEQ ID NO: 1585606 - RNA, 19 nt, Homo sapiens
aaagaauccagcaugaaua

SEQ ID NO: 1585607 - RNA, 19 nt, Homo sapiens
guaaauaaggucagaggau

SEQ ID NO: 1585608 - RNA, 19 nt, Homo sapiens
ugccaaagauggugaauac

SEQ ID NO: 1585609 - RNA, 19 nt, Homo sapiens
agaacaagaccaugaggua

SEQ ID NO: 1585610 - RNA, 19 nt, Homo sapiens
ucuaguauguucagugguu

SEQ ID NO: 1585611 - RNA, 19 nt, Homo sapiens
gaacaagaugguauaguac

SEQ ID NO: 1585612 - RNA, 19 nt, Homo sapiens
ucaccagaauguuaaacuu

SEQ ID NO: 1585613 - RNA, 19 nt, Homo sapiens
gacaaugaaggaaacaauu

SEQ ID NO: 1585614 - RNA, 19 nt, Homo sapiens
ugaugacgcauuaauguaa

SEQ ID NO: 1585615 - RNA, 19 nt, Homo sapiens
gcuaacagcaauuucauag

SEQ ID NO: 1585616 - RNA, 19 nt, Homo sapiens
guacggacaauacagaaga

SEQ ID NO: 1585617 - RNA, 19 nt, Homo sapiens
caaacgcaauacacugaau

SEQ ID NO: 1585618 - RNA, 19 nt, Homo sapiens
gaacucgguauaaauguca

SEQ ID NO: 1585619 - RNA, 19 nt, Homo sapiens
acaacuggcuaucaaauac

SEQ ID NO: 1585620 - RNA, 19 nt, Homo sapiens
ggauguuccuucaacuugu

SEQ ID NO: 1585621 - RNA, 19 nt, Homo sapiens
ugacucaccagaauguuaa

SEQ ID NO: 1585622 - RNA, 19 nt, Homo sapiens
ugaauggcuucuaaacaau

SEQ ID NO: 1585623 - RNA, 19 nt, Homo sapiens
ccucaguuaucuaucugua

SEQ ID NO: 1585624 - RNA, 19 nt, Homo sapiens
gacaaaggccuuaugaacu

SEQ ID NO: 1585625 - RNA, 19 nt, Homo sapiens
gaaguagaaucacauguaa

SEQ ID NO: 1585626 - RNA, 19 nt, Homo sapiens
cuacauaccagaucuauua

SEQ ID NO: 1585627 - RNA, 19 nt, Homo sapiens
ccagaucuauuacaugaua

SEQ ID NO: 1585628 - RNA, 19 nt, Homo sapiens
uaacuauccuggaauguuu

SEQ ID NO: 1585629 - RNA, 19 nt, Homo sapiens
caaguuaacuauccuggaa

SEQ ID NO: 1585630 - RNA, 19 nt, Homo sapiens
gaagcacucuaagcuauuu

SEQ ID NO: 1585631 - RNA, 19 nt, Homo sapiens
ggaaagggaaggaggauuu

SEQ ID NO: 1585632 - RNA, 19 nt, Homo sapiens
guaaaccugugaaguagaa

SEQ ID NO: 1585633 - RNA, 19 nt, Homo sapiens
aaaguaaaccugugaagua

SEQ ID NO: 1585634 - RNA, 19 nt, Homo sapiens
gcaucugaauuuaaccuua

SEQ ID NO: 1585635 - RNA, 19 nt, Homo sapiens
ggaaauaucaugagucaca

SEQ ID NO: 1585636 - RNA, 19 nt, Homo sapiens
gaagcaagaagcacucuaa

SEQ ID NO: 1585637 - RNA, 19 nt, Homo sapiens
acagagaaauguacagaaa

SEQ ID NO: 1585638 - RNA, 19 nt, Homo sapiens
ggagaaggcugagaagcaa

SEQ ID NO: 1585639 - RNA, 19 nt, Homo sapiens
gauggaagauuuacaaggu

SEQ ID NO: 1585640 - RNA, 19 nt, Homo sapiens
guaaaugccuuggaaaaua

SEQ ID NO: 1585641 - RNA, 19 nt, Homo sapiens
guacagaaaugaagauggu

SEQ ID NO: 1585642 - RNA, 19 nt, Homo sapiens
ggauagcuuuaacaucuaa

SEQ ID NO: 1585643 - RNA, 19 nt, Homo sapiens
uaccagaucuauuacauga

SEQ ID NO: 1585644 - RNA, 19 nt, Homo sapiens
gcgcuuuccuuuguaauuu

SEQ ID NO: 1585645 - RNA, 19 nt, Homo sapiens
caucagaaauggauagcuu

SEQ ID NO: 1585646 - RNA, 19 nt, Homo sapiens
gagaguaacugugcuugga

SEQ ID NO: 1585647 - RNA, 19 nt, Homo sapiens
guuuaucggugcaauguuu

SEQ ID NO: 1585648 - RNA, 19 nt, Homo sapiens
ccauuucaguuucauauug

SEQ ID NO: 1585649 - RNA, 19 nt, Homo sapiens
uuucagggcuuaaacacua

SEQ ID NO: 1585650 - RNA, 19 nt, Homo sapiens
gggaacagaugaauaugca

SEQ ID NO: 1585651 - RNA, 19 nt, Homo sapiens
agagaaauguacagaaaug

SEQ ID NO: 1585652 - RNA, 19 nt, Homo sapiens
gaauuuagaagagcaugua

SEQ ID NO: 1585653 - RNA, 19 nt, Homo sapiens
ugaaagagguuccgcaacu

SEQ ID NO: 1585654 - RNA, 19 nt, Homo sapiens
uaacugugcuuggaauaga

SEQ ID NO: 1585655 - RNA, 19 nt, Homo sapiens
acaugggacuuuccacaua

SEQ ID NO: 1585656 - RNA, 19 nt, Homo sapiens
gcacugcccuagccucauc

SEQ ID NO: 1585657 - RNA, 19 nt, Homo sapiens
ggagugagcgcuaaguguu

SEQ ID NO: 1585658 - RNA, 19 nt, Homo sapiens
ugggagagcuggcuuuaau

SEQ ID NO: 1585659 - RNA, 19 nt, Homo sapiens
ccacacauuucuccuuuca

SEQ ID NO: 1585660 - RNA, 19 nt, Homo sapiens
gcucagacagcuuaggaua

SEQ ID NO: 1585661 - RNA, 19 nt, Homo sapiens
aagaagcacucuaagcuau

SEQ ID NO: 1585662 - RNA, 19 nt, Homo sapiens
gaaagagguuccgcaacug

SEQ ID NO: 1585663 - RNA, 19 nt, Homo sapiens
gaaauuauuguucccuuca

SEQ ID NO: 1585664 - RNA, 19 nt, Homo sapiens
guaacagucucugcgcuuu

SEQ ID NO: 1585665 - RNA, 19 nt, Homo sapiens
gcaagaagcacucuaagcu

SEQ ID NO: 1585666 - RNA, 19 nt, Homo sapiens
uuaaugucguccagaauuu

SEQ ID NO: 1585667 - RNA, 19 nt, Homo sapiens
agaaguagaaucacaugua

SEQ ID NO: 1585668 - RNA, 19 nt, Homo sapiens
caagaagcacucuaagcua

SEQ ID NO: 1585669 - RNA, 19 nt, Homo sapiens
uguggacacugaugaaauu

SEQ ID NO: 1585670 - RNA, 19 nt, Homo sapiens
aagaauaccagaaguagaa

SEQ ID NO: 1585671 - RNA, 19 nt, Homo sapiens
guucaguaccugcuacaua

SEQ ID NO: 1585672 - RNA, 19 nt, Homo sapiens
ggauacgcuugguagcuuu

SEQ ID NO: 1585673 - RNA, 19 nt, Homo sapiens
gggauacgcuugguagcuu

SEQ ID NO: 1585674 - RNA, 19 nt, Homo sapiens
gcagggagaaggcugagaa

SEQ ID NO: 1585675 - RNA, 19 nt, Homo sapiens
gaaauggauagcuuuaaca

SEQ ID NO: 1585676 - RNA, 19 nt, Homo sapiens
ggauggaaauaucaugagu

SEQ ID NO: 1585677 - RNA, 19 nt, Homo sapiens
gaaauguacagaaaugaag

SEQ ID NO: 1585678 - RNA, 19 nt, Homo sapiens
uaaggauacugcugagugu

SEQ ID NO: 1585679 - RNA, 19 nt, Homo sapiens
ucagaaauggauagcuuua

SEQ ID NO: 1585680 - RNA, 19 nt, Homo sapiens
ggcaagaccagcugaaaga

SEQ ID NO: 1585681 - RNA, 19 nt, Homo sapiens
ucucugcgcuuuccuuugu

SEQ ID NO: 1585682 - RNA, 19 nt, Homo sapiens
uuaaaucccuccucaacuc

SEQ ID NO: 1585683 - RNA, 19 nt, Homo sapiens
guuaaugucguccagaauu

SEQ ID NO: 1585684 - RNA, 19 nt, Homo sapiens
uaauagcauuuccuucugu

SEQ ID NO: 1585685 - RNA, 19 nt, Homo sapiens
gaguaacugugcuuggaau

SEQ ID NO: 1585686 - RNA, 19 nt, Homo sapiens
ucaaugaccugggacaucu

SEQ ID NO: 1585687 - RNA, 19 nt, Homo sapiens
cauaccagaucuauuacau

SEQ ID NO: 1585688 - RNA, 19 nt, Homo sapiens
gagcuggcuuuaauacucu

SEQ ID NO: 1585689 - RNA, 19 nt, Homo sapiens
agccuucagugaucuauaa

SEQ ID NO: 1585690 - RNA, 19 nt, Homo sapiens
auggauagcuuuaacaucu

SEQ ID NO: 1585691 - RNA, 19 nt, Homo sapiens
agaaauggauagcuuuaac

SEQ ID NO: 1585692 - RNA, 19 nt, Homo sapiens
caugauaggauggaaauau

SEQ ID NO: 1585693 - RNA, 19 nt, Homo sapiens
gauauuugaaacugggaua

SEQ ID NO: 1585694 - RNA, 19 nt, Homo sapiens
uaaagaauaccagaaguag

SEQ ID NO: 1585695 - RNA, 19 nt, Homo sapiens
ggagagcuggcuuuaauac

SEQ ID NO: 1585696 - RNA, 19 nt, Homo sapiens
gggagagcuggcuuuaaua

SEQ ID NO: 1585697 - RNA, 19 nt, Homo sapiens
ggacuuuccacauaguaga

SEQ ID NO: 1585698 - RNA, 19 nt, Homo sapiens
gggagaaggcugagaagca

SEQ ID NO: 1585699 - RNA, 19 nt, Homo sapiens
ucacaucuauaguaaccau

SEQ ID NO: 1585700 - RNA, 19 nt, Homo sapiens
uggaauguuugaauugaug

SEQ ID NO: 1585701 - RNA, 19 nt, Homo sapiens
ccuggaauguuugaauuga

SEQ ID NO: 1585702 - RNA, 19 nt, Homo sapiens
cgacacacucuaugaacuu

SEQ ID NO: 1585703 - RNA, 19 nt, Homo sapiens
ucagacagcuuaggauagg

SEQ ID NO: 1585704 - RNA, 19 nt, Homo sapiens
guguuaaugucguccagaa

SEQ ID NO: 1585705 - RNA, 19 nt, Homo sapiens
gagaaauguacagaaauga

SEQ ID NO: 1585706 - RNA, 19 nt, Homo sapiens
caaaguaaaccugugaagu

SEQ ID NO: 1585707 - RNA, 19 nt, Homo sapiens
gagugagcgcuaaguguuu

SEQ ID NO: 1585708 - RNA, 19 nt, Homo sapiens
acacauuucuccuuucacu

SEQ ID NO: 1585709 - RNA, 19 nt, Homo sapiens
caugggacuuuccacauag

SEQ ID NO: 1585710 - RNA, 19 nt, Homo sapiens
caagguaugggugagagua

SEQ ID NO: 1585711 - RNA, 19 nt, Homo sapiens
uggaagauuuacaagguau

SEQ ID NO: 1585712 - RNA, 19 nt, Homo sapiens
caucuucagccuucaguga

SEQ ID NO: 1585713 - RNA, 19 nt, Homo sapiens
uaccagaaguagaaucaca

SEQ ID NO: 1585714 - RNA, 19 nt, Homo sapiens
gagugucuuugcagauuca

SEQ ID NO: 1585715 - RNA, 19 nt, Homo sapiens
cuccacacauuucuccuuu

SEQ ID NO: 1585716 - RNA, 19 nt, Homo sapiens
gaggcgacacacucuauga

SEQ ID NO: 1585717 - RNA, 19 nt, Homo sapiens
gcgacacacucuaugaacu

SEQ ID NO: 1585718 - RNA, 19 nt, Homo sapiens
agagcuggcuuuaauacuc

SEQ ID NO: 1585719 - RNA, 19 nt, Homo sapiens
auauguaaaugccuuggaa

SEQ ID NO: 1585720 - RNA, 19 nt, Homo sapiens
uggauagcuuuaacaucua

SEQ ID NO: 1585721 - RNA, 19 nt, Homo sapiens
aaguaaaccugugaaguag

SEQ ID NO: 1585722 - RNA, 19 nt, Homo sapiens
gagaagcaagcaggaguga

SEQ ID NO: 1585723 - RNA, 19 nt, Homo sapiens
ggagauaaucaagcucaga

SEQ ID NO: 1585724 - RNA, 19 nt, Homo sapiens
cugagugucuuugcagauu

SEQ ID NO: 1585725 - RNA, 19 nt, Homo sapiens
gaagauacauguacuauag

SEQ ID NO: 1585726 - RNA, 19 nt, Homo sapiens
gauagucacuccauuuaua

SEQ ID NO: 1585727 - RNA, 19 nt, Homo sapiens
gaaccacucuucuuugaaa

SEQ ID NO: 1585728 - RNA, 19 nt, Homo sapiens
guauauagcuaguuacaga

SEQ ID NO: 1585729 - RNA, 19 nt, Homo sapiens
caacaucccucuugcucua

SEQ ID NO: 1585730 - RNA, 19 nt, Homo sapiens
gaggugcacugucuucuuu

SEQ ID NO: 1585731 - RNA, 19 nt, Homo sapiens
gaaccuuaguguauuugua

SEQ ID NO: 1585732 - RNA, 19 nt, Homo sapiens
ugaaguauaugaugaguga

SEQ ID NO: 1585733 - RNA, 19 nt, Homo sapiens
gcuauguguuucuucauua

SEQ ID NO: 1585734 - RNA, 19 nt, Homo sapiens
ugacuugaguucuuuauga

SEQ ID NO: 1585735 - RNA, 19 nt, Homo sapiens
gaaaagauucuguggauua

SEQ ID NO: 1585736 - RNA, 19 nt, Homo sapiens
gaucucgccucucaguuaa

SEQ ID NO: 1585737 - RNA, 19 nt, Homo sapiens
ccaccaagguuacuuugaa

SEQ ID NO: 1585738 - RNA, 19 nt, Homo sapiens
gaacacgccucucaauggu

SEQ ID NO: 1585739 - RNA, 19 nt, Homo sapiens
gaagggaauucacucuguu

SEQ ID NO: 1585740 - RNA, 19 nt, Homo sapiens
ggaaggcacuuuagaagac

SEQ ID NO: 1585741 - RNA, 19 nt, Homo sapiens
uaaaugagcccuggguuaa

SEQ ID NO: 1585742 - RNA, 19 nt, Homo sapiens
gauggaggcuggucucugu

SEQ ID NO: 1585743 - RNA, 19 nt, Homo sapiens
gcacacuacuaucacuuug

SEQ ID NO: 1585744 - RNA, 19 nt, Homo sapiens
gaaauaugggucucuguga

SEQ ID NO: 1585745 - RNA, 19 nt, Homo sapiens
ccgaaaggcucacagaugu

SEQ ID NO: 1585746 - RNA, 19 nt, Homo sapiens
cccuggagcuccuguaaua

SEQ ID NO: 1585747 - RNA, 19 nt, Homo sapiens
ggagcuauguguuucuuca

SEQ ID NO: 1585748 - RNA, 19 nt, Homo sapiens
ggaggucacugguauucug

SEQ ID NO: 1585749 - RNA, 19 nt, Homo sapiens
ggaggaauauuagcaacug

SEQ ID NO: 1585750 - RNA, 19 nt, Homo sapiens
gauauuacgcauuggcuuu

SEQ ID NO: 1585751 - RNA, 19 nt, Homo sapiens
ggucacugguauucuguuu

SEQ ID NO: 1585752 - RNA, 19 nt, Homo sapiens
gaucauggcacugcuauuc

SEQ ID NO: 1585753 - RNA, 19 nt, Homo sapiens
guuggaagaugcaaacugu

SEQ ID NO: 1585754 - RNA, 19 nt, Homo sapiens
gauuugacuugaguucuuu

SEQ ID NO: 1585755 - RNA, 19 nt, Homo sapiens
ggauuuccgugaucagaau

SEQ ID NO: 1585756 - RNA, 19 nt, Homo sapiens
uagaagaccucagcagugu

SEQ ID NO: 1585757 - RNA, 19 nt, Homo sapiens
agacuaagccaauuauuca

SEQ ID NO: 1585758 - RNA, 19 nt, Homo sapiens
ucacugguauucuguuugu

SEQ ID NO: 1585759 - RNA, 19 nt, Homo sapiens
uaacguaugaccugcaauu

SEQ ID NO: 1585760 - RNA, 19 nt, Homo sapiens
gaaagaguuuugugcugua

SEQ ID NO: 1585761 - RNA, 19 nt, Homo sapiens
cguaugaccugcaauuugg

SEQ ID NO: 1585762 - RNA, 19 nt, Homo sapiens
cagacuagauuugacuuga

SEQ ID NO: 1585763 - RNA, 19 nt, Homo sapiens
uuaaaugagcccuggguua

SEQ ID NO: 1585764 - RNA, 19 nt, Homo sapiens
uuuaauaucugcucuggau

SEQ ID NO: 1585765 - RNA, 19 nt, Homo sapiens
gaucagaauauaccugguu

SEQ ID NO: 1585766 - RNA, 19 nt, Homo sapiens
ggccgaggcuaacaaggaa

SEQ ID NO: 1585767 - RNA, 19 nt, Homo sapiens
caccaagguuacuuugaaa

SEQ ID NO: 1585768 - RNA, 19 nt, Homo sapiens
gcaguaacuuauguugaug

SEQ ID NO: 1585769 - RNA, 19 nt, Homo sapiens
gcagugugguucugugucu

SEQ ID NO: 1585770 - RNA, 19 nt, Homo sapiens
cauguacuauagaucauug

SEQ ID NO: 1585771 - RNA, 19 nt, Homo sapiens
ugagggaacugauuguuuu

SEQ ID NO: 1585772 - RNA, 19 nt, Homo sapiens
ggaauauuagcaacuguau

SEQ ID NO: 1585773 - RNA, 19 nt, Homo sapiens
caagguuacuuugaaaucu

SEQ ID NO: 1585774 - RNA, 19 nt, Homo sapiens
gaagacuaagccaauuauu

SEQ ID NO: 1585775 - RNA, 19 nt, Homo sapiens
gaggcaggcagccagguua

SEQ ID NO: 1585776 - RNA, 19 nt, Homo sapiens
acacuacuaucacuuugga

SEQ ID NO: 1585777 - RNA, 19 nt, Homo sapiens
gauuugaucuaccucuaag

SEQ ID NO: 1585778 - RNA, 19 nt, Homo sapiens
gagcuccuguaauaagaau

SEQ ID NO: 1585779 - RNA, 19 nt, Homo sapiens
gcuggucucugucugaaag

SEQ ID NO: 1585780 - RNA, 19 nt, Homo sapiens
aaauuuaccaggagaaaga

SEQ ID NO: 1585781 - RNA, 19 nt, Homo sapiens
gaugcaaacuguggaugau

SEQ ID NO: 1585782 - RNA, 19 nt, Homo sapiens
gcggguaugucccacuguu

SEQ ID NO: 1585783 - RNA, 19 nt, Homo sapiens
gguccagucuugacaaagg

SEQ ID NO: 1585784 - RNA, 19 nt, Homo sapiens
ugugaaccuuaguguauuu

SEQ ID NO: 1585785 - RNA, 19 nt, Homo sapiens
agaucucgccucucaguua

SEQ ID NO: 1585786 - RNA, 19 nt, Homo sapiens
gucuacagauacagaauug

SEQ ID NO: 1585787 - RNA, 19 nt, Homo sapiens
aauaaacucuuggaagcuu

SEQ ID NO: 1585788 - RNA, 19 nt, Homo sapiens
gcauuuugcuacaggauuu

SEQ ID NO: 1585789 - RNA, 19 nt, Homo sapiens
ugcaguaacuuauguugau

SEQ ID NO: 1585790 - RNA, 19 nt, Homo sapiens
aaugugaaccuuaguguau

SEQ ID NO: 1585791 - RNA, 19 nt, Homo sapiens
gugagggaacugauuguuu

SEQ ID NO: 1585792 - RNA, 19 nt, Homo sapiens
aaacuuccauuagagaauc

SEQ ID NO: 1585793 - RNA, 19 nt, Homo sapiens
gacgggagcuauguguuuc

SEQ ID NO: 1585794 - RNA, 19 nt, Homo sapiens
gcagccagguuacgaagac

SEQ ID NO: 1585795 - RNA, 19 nt, Homo sapiens
gacuagauuugacuugagu

SEQ ID NO: 1585796 - RNA, 19 nt, Homo sapiens
ggauagucacuccauuuau

SEQ ID NO: 1585797 - RNA, 19 nt, Homo sapiens
agauuugacuugaguucuu

SEQ ID NO: 1585798 - RNA, 19 nt, Homo sapiens
augauuguguauccuguua

SEQ ID NO: 1585799 - RNA, 19 nt, Homo sapiens
gaaucauuaaggcuguuua

SEQ ID NO: 1585800 - RNA, 19 nt, Homo sapiens
agacgggagcuauguguuu

SEQ ID NO: 1585801 - RNA, 19 nt, Homo sapiens
caugaccuguaccugagua

SEQ ID NO: 1585802 - RNA, 19 nt, Homo sapiens
uaagccaauuauucacuga

SEQ ID NO: 1585803 - RNA, 19 nt, Homo sapiens
gcguaagcaugagcuggua

SEQ ID NO: 1585804 - RNA, 19 nt, Homo sapiens
ucauggcacugcuauucuu

SEQ ID NO: 1585805 - RNA, 19 nt, Homo sapiens
cuacaggauuuccgugauc

SEQ ID NO: 1585806 - RNA, 19 nt, Homo sapiens
cauguuaaaugugaaccuu

SEQ ID NO: 1585807 - RNA, 19 nt, Homo sapiens
uaauaagaaugugguugga

SEQ ID NO: 1585808 - RNA, 19 nt, Homo sapiens
cgaagacuaagccaauuau

SEQ ID NO: 1585809 - RNA, 19 nt, Homo sapiens
gcagaggugcacugucuuc

SEQ ID NO: 1585810 - RNA, 19 nt, Homo sapiens
uuucucuucuuccucuuua

SEQ ID NO: 1585811 - RNA, 19 nt, Homo sapiens
ggaacugauuguuuuguug

SEQ ID NO: 1585812 - RNA, 19 nt, Homo sapiens
uauugguugucuacagaua

SEQ ID NO: 1585813 - RNA, 19 nt, Homo sapiens
gagaaucauuaaggcuguu

SEQ ID NO: 1585814 - RNA, 19 nt, Homo sapiens
cuacuuccaugaccuguac

SEQ ID NO: 1585815 - RNA, 19 nt, Homo sapiens
gcuacaggauuuccgugau

SEQ ID NO: 1585816 - RNA, 19 nt, Homo sapiens
uaugaugagugaggaguug

SEQ ID NO: 1585817 - RNA, 19 nt, Homo sapiens
gauuguuccuuaaacuagu

SEQ ID NO: 1585818 - RNA, 19 nt, Homo sapiens
auuagcaacuguauugguu

SEQ ID NO: 1585819 - RNA, 19 nt, Homo sapiens
aggaacaccaccaagguua

SEQ ID NO: 1585820 - RNA, 19 nt, Homo sapiens
gugguucugugucuacuuc

SEQ ID NO: 1585821 - RNA, 19 nt, Homo sapiens
gaagaugcaaacuguggau

SEQ ID NO: 1585822 - RNA, 19 nt, Homo sapiens
uuacgaagacuaagccaau

SEQ ID NO: 1585823 - RNA, 19 nt, Homo sapiens
gugauuguuccuuaaacua

SEQ ID NO: 1585824 - RNA, 19 nt, Homo sapiens
gaucaucaccuccauuuuc

SEQ ID NO: 1585825 - RNA, 19 nt, Homo sapiens
gggaggagcuuacauauaa

SEQ ID NO: 1585826 - RNA, 19 nt, Homo sapiens
aaacauagcugaagaaauc

SEQ ID NO: 1585827 - RNA, 19 nt, Homo sapiens
aaagaaaccuggugccuua

SEQ ID NO: 1585828 - RNA, 19 nt, Homo sapiens
ggaaagaagaguccaaaua

SEQ ID NO: 1585829 - RNA, 19 nt, Homo sapiens
gggcaaaucuggaugcuaa

SEQ ID NO: 1585830 - RNA, 19 nt, Homo sapiens
gcaacaugcucuccaguuu

SEQ ID NO: 1585831 - RNA, 19 nt, Homo sapiens
gaaauucacagaagcuaua

SEQ ID NO: 1585832 - RNA, 19 nt, Homo sapiens
gaaucuaacuugcuuuguu

SEQ ID NO: 1585833 - RNA, 19 nt, Homo sapiens
ggucguaacuuucuuuaug

SEQ ID NO: 1585834 - RNA, 19 nt, Homo sapiens
gaagucauguucagguaaa

SEQ ID NO: 1585835 - RNA, 19 nt, Homo sapiens
gacacagucuucaaguuua

SEQ ID NO: 1585836 - RNA, 19 nt, Homo sapiens
gcaagagucuguuacaaag

SEQ ID NO: 1585837 - RNA, 19 nt, Homo sapiens
gcuaauugcuaacuaaaug

SEQ ID NO: 1585838 - RNA, 19 nt, Homo sapiens
gaagggaaauucacagaag

SEQ ID NO: 1585839 - RNA, 19 nt, Homo sapiens
gaaagaagaguccaaauac

SEQ ID NO: 1585840 - RNA, 19 nt, Homo sapiens
ucacaaggauucagcuaaa

SEQ ID NO: 1585841 - RNA, 19 nt, Homo sapiens
gaaaccucaugaacugaua

SEQ ID NO: 1585842 - RNA, 19 nt, Homo sapiens
gaagucuugugcauacuaa

SEQ ID NO: 1585843 - RNA, 19 nt, Homo sapiens
aaacaacacuggguaauuc

SEQ ID NO: 1585844 - RNA, 19 nt, Homo sapiens
gguauuggcugcucugugu

SEQ ID NO: 1585845 - RNA, 19 nt, Homo sapiens
gaugcuaauugcuaacuaa

SEQ ID NO: 1585846 - RNA, 19 nt, Homo sapiens
ccacugagcacucuaggua

SEQ ID NO: 1585847 - RNA, 19 nt, Homo sapiens
gaauguacaccuucauauu

SEQ ID NO: 1585848 - RNA, 19 nt, Homo sapiens
ccacaccacugcccuuuga

SEQ ID NO: 1585849 - RNA, 19 nt, Homo sapiens
gaagguggaauuuggagua

SEQ ID NO: 1585850 - RNA, 19 nt, Homo sapiens
acaauucgcuaucgagaaa

SEQ ID NO: 1585851 - RNA, 19 nt, Homo sapiens
cagcauaugucccaaggaa

SEQ ID NO: 1585852 - RNA, 19 nt, Homo sapiens
gaaucaauaugucacugaa

SEQ ID NO: 1585853 - RNA, 19 nt, Homo sapiens
gaaacaacacuggguaauu

SEQ ID NO: 1585854 - RNA, 19 nt, Homo sapiens
ccaagucacugucccaaug

SEQ ID NO: 1585855 - RNA, 19 nt, Homo sapiens
ccacugcccuuugaaugua

SEQ ID NO: 1585856 - RNA, 19 nt, Homo sapiens
gcacccauguuuguuguuu

SEQ ID NO: 1585857 - RNA, 19 nt, Homo sapiens
caaggaaacuaaucccaau

SEQ ID NO: 1585858 - RNA, 19 nt, Homo sapiens
cuaauggucucuuaacaug

SEQ ID NO: 1585859 - RNA, 19 nt, Homo sapiens
ggacagauuccacugaaga

SEQ ID NO: 1585860 - RNA, 19 nt, Homo sapiens
ggaauuuggaguaagauuu

SEQ ID NO: 1585861 - RNA, 19 nt, Homo sapiens
ccggaaacauugcaaacua

SEQ ID NO: 1585862 - RNA, 19 nt, Homo sapiens
guugcuaacugcacucuuu

SEQ ID NO: 1585863 - RNA, 19 nt, Homo sapiens
ccaacacaguuuaugaauu

SEQ ID NO: 1585864 - RNA, 19 nt, Homo sapiens
gaacacacauaaacauagc

SEQ ID NO: 1585865 - RNA, 19 nt, Homo sapiens
ccauguuuguuguuucuua

SEQ ID NO: 1585866 - RNA, 19 nt, Homo sapiens
ggauauggcagcaauguau

SEQ ID NO: 1585867 - RNA, 19 nt, Homo sapiens
gaaacuaaucccaauaaca

SEQ ID NO: 1585868 - RNA, 19 nt, Homo sapiens
gaaagacaauguggaaggu

SEQ ID NO: 1585869 - RNA, 19 nt, Homo sapiens
gcacagaaauugccaaaag

SEQ ID NO: 1585870 - RNA, 19 nt, Homo sapiens
gaagaguccaaauacagua

SEQ ID NO: 1585871 - RNA, 19 nt, Homo sapiens
ugacacagucuucaaguuu

SEQ ID NO: 1585872 - RNA, 19 nt, Homo sapiens
gcagcaauguaucaccaaa

SEQ ID NO: 1585873 - RNA, 19 nt, Homo sapiens
ggaggagcuuacauauaaa

SEQ ID NO: 1585874 - RNA, 19 nt, Homo sapiens
agauuccacugaagaguua

SEQ ID NO: 1585875 - RNA, 19 nt, Homo sapiens
gcacgacccacaacaguga

SEQ ID NO: 1585876 - RNA, 19 nt, Homo sapiens
gaauguuacucacaaggau

SEQ ID NO: 1585877 - RNA, 19 nt, Homo sapiens
ucaagcaagugauucagaa

SEQ ID NO: 1585878 - RNA, 19 nt, Homo sapiens
gguggaauuuggaguaaga

SEQ ID NO: 1585879 - RNA, 19 nt, Homo sapiens
ucuaauaccucaguuugaa

SEQ ID NO: 1585880 - RNA, 19 nt, Homo sapiens
caauaacaaucaucaagca

SEQ ID NO: 1585881 - RNA, 19 nt, Homo sapiens
ucacagaagcuauaguuga

SEQ ID NO: 1585882 - RNA, 19 nt, Homo sapiens
ccuguaagcccaacacuuu

SEQ ID NO: 1585883 - RNA, 19 nt, Homo sapiens
acucugugcuuucugcuua

SEQ ID NO: 1585884 - RNA, 19 nt, Homo sapiens
aauguucucuggauggaua

SEQ ID NO: 1585885 - RNA, 19 nt, Homo sapiens
acacauuuacugcaucuua

SEQ ID NO: 1585886 - RNA, 19 nt, Homo sapiens
auacuaguccaccuuauua

SEQ ID NO: 1585887 - RNA, 19 nt, Homo sapiens
gauacuaguccaccuuauu

SEQ ID NO: 1585888 - RNA, 19 nt, Homo sapiens
uaauaaggguggaaagaag

SEQ ID NO: 1585889 - RNA, 19 nt, Homo sapiens
gugguuaaccuuccucuuu

SEQ ID NO: 1585890 - RNA, 19 nt, Homo sapiens
caacacuggguaauucuaa

SEQ ID NO: 1585891 - RNA, 19 nt, Homo sapiens
uaacaaucaucaagcaagu

SEQ ID NO: 1585892 - RNA, 19 nt, Homo sapiens
guaaaacccaucagucuua

SEQ ID NO: 1585893 - RNA, 19 nt, Homo sapiens
ggacacauuuacugcaucu

SEQ ID NO: 1585894 - RNA, 19 nt, Homo sapiens
aaagaagaguccaaauaca

SEQ ID NO: 1585895 - RNA, 19 nt, Homo sapiens
ggaaacauugcaaacuauu

SEQ ID NO: 1585896 - RNA, 19 nt, Homo sapiens
cacagaagcuauaguugau

SEQ ID NO: 1585897 - RNA, 19 nt, Homo sapiens
aaucaaauguucucuggau

SEQ ID NO: 1585898 - RNA, 19 nt, Homo sapiens
aaucuaacuugcuuuguug

SEQ ID NO: 1585899 - RNA, 19 nt, Homo sapiens
ugcauuagauguuucagaa

SEQ ID NO: 1585900 - RNA, 19 nt, Homo sapiens
cauauaaagccacguaguu

SEQ ID NO: 1585901 - RNA, 19 nt, Homo sapiens
ucuauugucucucuuaaca

SEQ ID NO: 1585902 - RNA, 19 nt, Homo sapiens
cagaugcacucaagacaca

SEQ ID NO: 1585903 - RNA, 19 nt, Homo sapiens
ccaaauacaguagcuuaaa

SEQ ID NO: 1585904 - RNA, 19 nt, Homo sapiens
cagacugcuucuuauaauu

SEQ ID NO: 1585905 - RNA, 19 nt, Homo sapiens
ggaagucuugugcauacua

SEQ ID NO: 1585906 - RNA, 19 nt, Homo sapiens
agacacaauuagcuaagaa

SEQ ID NO: 1585907 - RNA, 19 nt, Homo sapiens
ccacaucaauaccacaagu

SEQ ID NO: 1585908 - RNA, 19 nt, Homo sapiens
ggguggugauugcuuaauu

SEQ ID NO: 1585909 - RNA, 19 nt, Homo sapiens
gagaaucuaacuugcuuug

SEQ ID NO: 1585910 - RNA, 19 nt, Homo sapiens
gaaggaaaccuggaagucu

SEQ ID NO: 1585911 - RNA, 19 nt, Homo sapiens
ggaugcuaauugcuaacua

SEQ ID NO: 1585912 - RNA, 19 nt, Homo sapiens
ccugggaaaugcacagaaa

SEQ ID NO: 1585913 - RNA, 19 nt, Homo sapiens
guccaaauguaaagcuuga

SEQ ID NO: 1585914 - RNA, 19 nt, Homo sapiens
gauggauacauacugauuu

SEQ ID NO: 1585915 - RNA, 19 nt, Homo sapiens
ggauggauacauacugauu

SEQ ID NO: 1585916 - RNA, 19 nt, Homo sapiens
caaauguucucuggaugga

SEQ ID NO: 1585917 - RNA, 19 nt, Homo sapiens
cggaaacauugcaaacuau

SEQ ID NO: 1585918 - RNA, 19 nt, Homo sapiens
aagagaaucuaacuugcuu

SEQ ID NO: 1585919 - RNA, 19 nt, Homo sapiens
gaaugaaggaaaccuggaa

SEQ ID NO: 1585920 - RNA, 19 nt, Homo sapiens
gcaaaucuggaugcuaauu

SEQ ID NO: 1585921 - RNA, 19 nt, Homo sapiens
cugcaucccuaauguuuga

SEQ ID NO: 1585922 - RNA, 19 nt, Homo sapiens
aagaagucauguucaggua

SEQ ID NO: 1585923 - RNA, 19 nt, Homo sapiens
aaacccaucagucuuaauu

SEQ ID NO: 1585924 - RNA, 19 nt, Homo sapiens
gguggugauugcuuaauuc

SEQ ID NO: 1585925 - RNA, 19 nt, Homo sapiens
caaauaugcugcugaguuu

SEQ ID NO: 1585926 - RNA, 19 nt, Homo sapiens
gaagagggcuuuauugaac

SEQ ID NO: 1585927 - RNA, 19 nt, Homo sapiens
gaauaugccuuccggaaau

SEQ ID NO: 1585928 - RNA, 19 nt, Homo sapiens
ggagguggcugccgaugaa

SEQ ID NO: 1585929 - RNA, 19 nt, Homo sapiens
gagcaggagagaaagauua

SEQ ID NO: 1585930 - RNA, 19 nt, Homo sapiens
cagcauggcuucaacuuca

SEQ ID NO: 1585931 - RNA, 19 nt, Homo sapiens
ggaagagggcuuuauugaa

SEQ ID NO: 1585932 - RNA, 19 nt, Homo sapiens
ugagggaccauauugauua

SEQ ID NO: 1585933 - RNA, 19 nt, Homo sapiens
ccauaaagacagcuaauuu

SEQ ID NO: 1585934 - RNA, 19 nt, Homo sapiens
ugauagagcuaccucagaa

SEQ ID NO: 1585935 - RNA, 19 nt, Homo sapiens
gcucaaguguucaaucuca

SEQ ID NO: 1585936 - RNA, 19 nt, Homo sapiens
gcuacacaauggccuuaua

SEQ ID NO: 1585937 - RNA, 19 nt, Homo sapiens
cauccucucugggaauuua

SEQ ID NO: 1585938 - RNA, 19 nt, Homo sapiens
ccaaauaugcugcugaguu

SEQ ID NO: 1585939 - RNA, 19 nt, Homo sapiens
gcaacaacuucaaggagau

SEQ ID NO: 1585940 - RNA, 19 nt, Homo sapiens
uaugacagguuaugugaug

SEQ ID NO: 1585941 - RNA, 19 nt, Homo sapiens
cagcaucugugacaacuuc

SEQ ID NO: 1585942 - RNA, 19 nt, Homo sapiens
acaauggccuuauagacuu

SEQ ID NO: 1585943 - RNA, 19 nt, Homo sapiens
gacccuggcucccugaaug

SEQ ID NO: 1585944 - RNA, 19 nt, Homo sapiens
gugacaacuucucggcuua

SEQ ID NO: 1585945 - RNA, 19 nt, Homo sapiens
ccaaagcccacaaucagaa

SEQ ID NO: 1585946 - RNA, 19 nt, Homo sapiens
cgacgguggugucagcaaa

SEQ ID NO: 1585947 - RNA, 19 nt, Homo sapiens
gcaaugacaagggugauga

SEQ ID NO: 1585948 - RNA, 19 nt, Homo sapiens
ggaagaguuugcugaacca

SEQ ID NO: 1585949 - RNA, 19 nt, Homo sapiens
gcaacuauccuuccagcau

SEQ ID NO: 1585950 - RNA, 19 nt, Homo sapiens
guuaugugauggccuaugu

SEQ ID NO: 1585951 - RNA, 19 nt, Homo sapiens
cggaagagggcuuuauuga

SEQ ID NO: 1585952 - RNA, 19 nt, Homo sapiens
uuucguggccuccuacuua

SEQ ID NO: 1585953 - RNA, 19 nt, Homo sapiens
cauaaagacagcuaauuuc

SEQ ID NO: 1585954 - RNA, 19 nt, Homo sapiens
ucacugagcucuccauccu

SEQ ID NO: 1585955 - RNA, 19 nt, Homo sapiens
gcaaagcaacaacuucaag

SEQ ID NO: 1585956 - RNA, 19 nt, Homo sapiens
gcaugagggaccauauuga

SEQ ID NO: 1585957 - RNA, 19 nt, Homo sapiens
gaaccagugcauugaggaa

SEQ ID NO: 1585958 - RNA, 19 nt, Homo sapiens
acacgacccucuccuaguc

SEQ ID NO: 1585959 - RNA, 19 nt, Homo sapiens
ggccugaaauagcugauag

SEQ ID NO: 1585960 - RNA, 19 nt, Homo sapiens
gcagcaaggccugaaauag

SEQ ID NO: 1585961 - RNA, 19 nt, Homo sapiens
caucaagccugaagaaacc

SEQ ID NO: 1585962 - RNA, 19 nt, Homo sapiens
gcacaggccaauaggcaau

SEQ ID NO: 1585963 - RNA, 19 nt, Homo sapiens
ugaaugccacaauaaggua

SEQ ID NO: 1585964 - RNA, 19 nt, Homo sapiens
gcaucaagccugaagaaac

SEQ ID NO: 1585965 - RNA, 19 nt, Homo sapiens
caauggccuuauagacuug

SEQ ID NO: 1585966 - RNA, 19 nt, Homo sapiens
caacuucaaccagcaguau

SEQ ID NO: 1585967 - RNA, 19 nt, Homo sapiens
cuaucuggcucaaguguuc

SEQ ID NO: 1585968 - RNA, 19 nt, Homo sapiens
gugcaaagcaacaacuuca

SEQ ID NO: 1585969 - RNA, 19 nt, Homo sapiens
ggcagcaaggccugaaaua

SEQ ID NO: 1585970 - RNA, 19 nt, Homo sapiens
ggaugguccucccaagaag

SEQ ID NO: 1585971 - RNA, 19 nt, Homo sapiens
agaauaugccuuccggaaa

SEQ ID NO: 1585972 - RNA, 19 nt, Homo sapiens
cuucaccgcugaccugugu

SEQ ID NO: 1585973 - RNA, 19 nt, Homo sapiens
gagggaccauauugauuac

SEQ ID NO: 1585974 - RNA, 19 nt, Homo sapiens
gcaccgggcugguuuugau

SEQ ID NO: 1585975 - RNA, 19 nt, Homo sapiens
gauacagcauggcuucaac

SEQ ID NO: 1585976 - RNA, 19 nt, Homo sapiens
ucauagaaccaaagucugu

SEQ ID NO: 1585977 - RNA, 19 nt, Homo sapiens
agacaagggugaacauucc

SEQ ID NO: 1585978 - RNA, 19 nt, Homo sapiens
acaggccaauaggcaauua

SEQ ID NO: 1585979 - RNA, 19 nt, Homo sapiens
ugugauggccuauguggaa

SEQ ID NO: 1585980 - RNA, 19 nt, Homo sapiens
gacaacuucucggcuuaug

SEQ ID NO: 1585981 - RNA, 19 nt, Homo sapiens
gauguucccagcaggcauu

SEQ ID NO: 1585982 - RNA, 19 nt, Homo sapiens
uagacuugguguuccugua

SEQ ID NO: 1585983 - RNA, 19 nt, Homo sapiens
ggagacgagcggugucaug

SEQ ID NO: 1585984 - RNA, 19 nt, Homo sapiens
uguccucagucucacgaua

SEQ ID NO: 1585985 - RNA, 19 nt, Homo sapiens
cagcaugagggaccauauu

SEQ ID NO: 1585986 - RNA, 19 nt, Homo sapiens
ggagcuaguaguccagguu

SEQ ID NO: 1585987 - RNA, 19 nt, Homo sapiens
caaagucugugcaguuccu

SEQ ID NO: 1585988 - RNA, 19 nt, Homo sapiens
gggugaacauuccuaucug

SEQ ID NO: 1585989 - RNA, 19 nt, Homo sapiens
cagugacgauggcgcaguu

SEQ ID NO: 1585990 - RNA, 19 nt, Homo sapiens
cgcgagagcaggagagaaa

SEQ ID NO: 1585991 - RNA, 19 nt, Homo sapiens
uagcaucaagccugaagaa

SEQ ID NO: 1585992 - RNA, 19 nt, Homo sapiens
ccgcugaccugugugagau

SEQ ID NO: 1585993 - RNA, 19 nt, Homo sapiens
cacaauggccuuauagacu

SEQ ID NO: 1585994 - RNA, 19 nt, Homo sapiens
gccauaaagacagcuaauu

SEQ ID NO: 1585995 - RNA, 19 nt, Homo sapiens
gauugcaccgggcugguuu

SEQ ID NO: 1585996 - RNA, 19 nt, Homo sapiens
cagcaaggccugaaauagc

SEQ ID NO: 1585997 - RNA, 19 nt, Homo sapiens
ggaaccugccucacuccaa

SEQ ID NO: 1585998 - RNA, 19 nt, Homo sapiens
caugagggaccauauugau

SEQ ID NO: 1585999 - RNA, 19 nt, Homo sapiens
aggcauuuaugacaccaaa

SEQ ID NO: 1586000 - RNA, 19 nt, Homo sapiens
uggcucaaguguucaaucu

SEQ ID NO: 1586001 - RNA, 19 nt, Homo sapiens
cagacaagggugaacauuc

SEQ ID NO: 1586002 - RNA, 19 nt, Homo sapiens
guuacaaggccguguguca

SEQ ID NO: 1586003 - RNA, 19 nt, Homo sapiens
uaguggaugugcaaagcaa

SEQ ID NO: 1586004 - RNA, 19 nt, Homo sapiens
gaaugccacaauaagguau

SEQ ID NO: 1586005 - RNA, 19 nt, Homo sapiens
gcaacccaccguccucauc

SEQ ID NO: 1586006 - RNA, 19 nt, Homo sapiens
ggcccacgcugaugaagac

SEQ ID NO: 1586007 - RNA, 19 nt, Homo sapiens
gauggccuauguggaagug

SEQ ID NO: 1586008 - RNA, 19 nt, Homo sapiens
ggccuccuacuuagaauau

SEQ ID NO: 1586009 - RNA, 19 nt, Homo sapiens
guucccagcaggcauuuau

SEQ ID NO: 1586010 - RNA, 19 nt, Homo sapiens
caaggcauccccuaccaua

SEQ ID NO: 1586011 - RNA, 19 nt, Homo sapiens
ugaccugugugagauguuc

SEQ ID NO: 1586012 - RNA, 19 nt, Homo sapiens
aaccaaagucugugcaguu

SEQ ID NO: 1586013 - RNA, 19 nt, Homo sapiens
caagggugaacauuccuau

SEQ ID NO: 1586014 - RNA, 19 nt, Homo sapiens
cucccugaaugccacaaua

SEQ ID NO: 1586015 - RNA, 19 nt, Homo sapiens
gauagcaucaagccugaag

SEQ ID NO: 1586016 - RNA, 19 nt, Homo sapiens
aaacggaagagggcuuuau

SEQ ID NO: 1586017 - RNA, 19 nt, Homo sapiens
cacaguguccucagucuca

SEQ ID NO: 1586018 - RNA, 19 nt, Homo sapiens
gagagcaggagagaaagau

SEQ ID NO: 1586019 - RNA, 19 nt, Homo sapiens
ugucauagaaccaaagucu

SEQ ID NO: 1586020 - RNA, 19 nt, Homo sapiens
ucacucugcugugcaugga

SEQ ID NO: 1586021 - RNA, 19 nt, Homo sapiens
acaggaagaguuugcugaa

SEQ ID NO: 1586022 - RNA, 19 nt, Homo sapiens
cgagagcaggagagaaaga

SEQ ID NO: 1586023 - RNA, 19 nt, Homo sapiens
ccaccagcaucugugacaa

SEQ ID NO: 1586024 - RNA, 19 nt, Homo sapiens
gcugaccugugugagaugu

SEQ ID NO: 1586025 - RNA, 19 nt, Homo sapiens
caaggaggccucugucauu

SEQ ID NO: 1586026 - RNA, 19 nt, Homo sapiens
ggaggccucugucauuuua

SEQ ID NO: 1586027 - RNA, 19 nt, Homo sapiens
agacucguguuuacaguuu

SEQ ID NO: 1586028 - RNA, 19 nt, Homo sapiens
cgcagaagaugaugcugua

SEQ ID NO: 1586029 - RNA, 19 nt, Homo sapiens
gagcagagcagaggugauc

SEQ ID NO: 1586030 - RNA, 19 nt, Homo sapiens
ggagaucaagcucuacuuc

SEQ ID NO: 1586031 - RNA, 19 nt, Homo sapiens
aaggaggccucugucauuu

SEQ ID NO: 1586032 - RNA, 19 nt, Homo sapiens
ugacgcugcugcugucugu

SEQ ID NO: 1586033 - RNA, 19 nt, Homo sapiens
gaucaagcucuacuucauc

SEQ ID NO: 1586034 - RNA, 19 nt, Homo sapiens
gagaucaagcucuacuuca

SEQ ID NO: 1586035 - RNA, 19 nt, Homo sapiens
agaucaagcucuacuucau

SEQ ID NO: 1586036 - RNA, 19 nt, Homo sapiens
caagcucuacuucaucuuc

SEQ ID NO: 1586037 - RNA, 19 nt, Homo sapiens
gugguuccuuuacaucuuc

SEQ ID NO: 1586038 - RNA, 19 nt, Homo sapiens
ccaaggaggccucugucau

SEQ ID NO: 1586039 - RNA, 19 nt, Homo sapiens
aaagacucguguuuacagu

SEQ ID NO: 1586040 - RNA, 19 nt, Homo sapiens
ucaccuucuucuacugcua

SEQ ID NO: 1586041 - RNA, 19 nt, Homo sapiens
ggccucaccuucuucuacu

SEQ ID NO: 1586042 - RNA, 19 nt, Homo sapiens
gaucggcgugugcaucauc

SEQ ID NO: 1586043 - RNA, 19 nt, Homo sapiens
ugugguuccuuuacaucuu

SEQ ID NO: 1586044 - RNA, 19 nt, Homo sapiens
uuucuuaucccguuuguua

SEQ ID NO: 1586045 - RNA, 19 nt, Homo sapiens
ggaggaagcggaacuagag

SEQ ID NO: 1586046 - RNA, 19 nt, Homo sapiens
uaauaaaggugugugaucu

SEQ ID NO: 1586047 - RNA, 19 nt, Homo sapiens
gggagggagggauuucuua

SEQ ID NO: 1586048 - RNA, 19 nt, Homo sapiens
aaaggugugugaucugguu

SEQ ID NO: 1586049 - RNA, 19 nt, Homo sapiens
ggagcccaguguccaguga

SEQ ID NO: 1586050 - RNA, 19 nt, Homo sapiens
ggagggagggauuucuuau

SEQ ID NO: 1586051 - RNA, 19 nt, Homo sapiens
ggaggacuacagccguaua

SEQ ID NO: 1586052 - RNA, 19 nt, Homo sapiens
ggacuacagccguauagag

SEQ ID NO: 1586053 - RNA, 19 nt, Homo sapiens
caaaccaccguguuacgaa

SEQ ID NO: 1586054 - RNA, 19 nt, Homo sapiens
ggaagcggaacuagagaug

SEQ ID NO: 1586055 - RNA, 19 nt, Homo sapiens
uguccaaaccaccguguua

SEQ ID NO: 1586056 - RNA, 19 nt, Homo sapiens
ggauaauaaagguguguga

SEQ ID NO: 1586057 - RNA, 19 nt, Homo sapiens
uaucccguuuguuacauuu

SEQ ID NO: 1586058 - RNA, 19 nt, Homo sapiens
gauaauaaaggugugugau

SEQ ID NO: 1586059 - RNA, 19 nt, Homo sapiens
gagggagggauuucuuauc

SEQ ID NO: 1586060 - RNA, 19 nt, Homo sapiens
cgaagaggcggugcugaug

SEQ ID NO: 1586061 - RNA, 19 nt, Homo sapiens
caagcggaaucggacaugu

SEQ ID NO: 1586062 - RNA, 19 nt, Homo sapiens
gugaucugguuuggugaaa

SEQ ID NO: 1586063 - RNA, 19 nt, Homo sapiens
gauuucuuaucccguuugu

SEQ ID NO: 1586064 - RNA, 19 nt, Homo sapiens
ccaaaccaccguguuacga

SEQ ID NO: 1586065 - RNA, 19 nt, Homo sapiens
gaggacuacagccguauag

SEQ ID NO: 1586066 - RNA, 19 nt, Homo sapiens
gaggaagcggaacuagaga

SEQ ID NO: 1586067 - RNA, 19 nt, Homo sapiens
gaacgagcucgaggaggau

SEQ ID NO: 1586068 - RNA, 19 nt, Homo sapiens
ccagcuggaccgacucaga

SEQ ID NO: 1586069 - RNA, 19 nt, Homo sapiens
gaaagacacugaagaaagu

SEQ ID NO: 1586070 - RNA, 19 nt, Homo sapiens
ggaagucuccugaguguaa

SEQ ID NO: 1586071 - RNA, 19 nt, Homo sapiens
gcaaagcaauccaauaaaa

SEQ ID NO: 1586072 - RNA, 19 nt, Homo sapiens
gaucuggucgccuccauua

SEQ ID NO: 1586073 - RNA, 19 nt, Homo sapiens
gagcucaucuucggacuug

SEQ ID NO: 1586074 - RNA, 19 nt, Homo sapiens
gagaguugguucacagcua

SEQ ID NO: 1586075 - RNA, 19 nt, Homo sapiens
gucguuagguauucuauuu

SEQ ID NO: 1586076 - RNA, 19 nt, Homo sapiens
gaugagaggagaagucuug

SEQ ID NO: 1586077 - RNA, 19 nt, Homo sapiens
gaacaagugcccucagcaa

SEQ ID NO: 1586078 - RNA, 19 nt, Homo sapiens
gaugagaggagaagucuug

SEQ ID NO: 1586079 - RNA, 19 nt, Homo sapiens
acacauaccuucacugcau

SEQ ID NO: 1586080 - RNA, 19 nt, Homo sapiens
gauaauuuccucauugguu

SEQ ID NO: 1586081 - RNA, 19 nt, Homo sapiens
uggcaaagcaauccaauaa

SEQ ID NO: 1586082 - RNA, 19 nt, Homo sapiens
caagugcccucagcaagaa

SEQ ID NO: 1586083 - RNA, 19 nt, Homo sapiens
ugaauucugcccuccauua

SEQ ID NO: 1586084 - RNA, 19 nt, Homo sapiens
gugcacagccacacccuua

SEQ ID NO: 1586085 - RNA, 19 nt, Homo sapiens
gcacagccacacccuuauu

SEQ ID NO: 1586086 - RNA, 19 nt, Homo sapiens
gcacagccacacccuuauu

SEQ ID NO: 1586087 - RNA, 19 nt, Homo sapiens
caagagagcauccuaucug

SEQ ID NO: 1586088 - RNA, 19 nt, Homo sapiens
gagaaagacaugaaagaca

SEQ ID NO: 1586089 - RNA, 19 nt, Homo sapiens
guacaauggugcgaacuca

SEQ ID NO: 1586090 - RNA, 19 nt, Homo sapiens
uuauucagcuggagaguug

SEQ ID NO: 1586091 - RNA, 19 nt, Homo sapiens
gcacgugccugagggaagu

SEQ ID NO: 1586092 - RNA, 19 nt, Homo sapiens
caugaaagacacugaagaa

SEQ ID NO: 1586093 - RNA, 19 nt, Homo sapiens
uaccucagccuuucccuua

SEQ ID NO: 1586094 - RNA, 19 nt, Homo sapiens
aaacuuucaugauccaaug

SEQ ID NO: 1586095 - RNA, 19 nt, Homo sapiens
gggauaauuuccucauugg

SEQ ID NO: 1586096 - RNA, 19 nt, Homo sapiens
ccauuaggauuaucugcuu

SEQ ID NO: 1586097 - RNA, 19 nt, Homo sapiens
gcaagaagccgugguagac

SEQ ID NO: 1586098 - RNA, 19 nt, Homo sapiens
aaacuuucaugcaccaaug

SEQ ID NO: 1586099 - RNA, 19 nt, Homo sapiens
ugggauaauuuccucauug

SEQ ID NO: 1586100 - RNA, 19 nt, Homo sapiens
ugaaagacacugaagaaag

SEQ ID NO: 1586101 - RNA, 19 nt, Homo sapiens
cguuagguauucuauuuga

SEQ ID NO: 1586102 - RNA, 19 nt, Homo sapiens
uaaaauaagcuaccuguga

SEQ ID NO: 1586103 - RNA, 19 nt, Homo sapiens
ccagacacgugugacugua

SEQ ID NO: 1586104 - RNA, 19 nt, Homo sapiens
aggaggagcucaucuuugg

SEQ ID NO: 1586105 - RNA, 19 nt, Homo sapiens
acacauaccuucgcugcau

SEQ ID NO: 1586106 - RNA, 19 nt, Homo sapiens
gguauucuauuugaguuca

SEQ ID NO: 1586107 - RNA, 19 nt, Homo sapiens
ccaggaggagcucaucuuu

SEQ ID NO: 1586108 - RNA, 19 nt, Homo sapiens
ugagggaagucuccugagu

SEQ ID NO: 1586109 - RNA, 19 nt, Homo sapiens
ucuuuggccuccaggauaa

SEQ ID NO: 1586110 - RNA, 19 nt, Homo sapiens
gguagacccugccugaaaa

SEQ ID NO: 1586111 - RNA, 19 nt, Homo sapiens
gaccaccaauggcaaagca

SEQ ID NO: 1586112 - RNA, 19 nt, Homo sapiens
cugcacagccacacccuua

SEQ ID NO: 1586113 - RNA, 19 nt, Homo sapiens
gugagaaagacaugaaaga

SEQ ID NO: 1586114 - RNA, 19 nt, Homo sapiens
guaccgcugucuccucaca

SEQ ID NO: 1586115 - RNA, 19 nt, Homo sapiens
agugauuggucguuaggua

SEQ ID NO: 1586116 - RNA, 19 nt, Homo sapiens
uagcguaccucagccuuuc

SEQ ID NO: 1586117 - RNA, 19 nt, Homo sapiens
cugaguaacuggaauugca

SEQ ID NO: 1586118 - RNA, 19 nt, Homo sapiens
cuucuggguucaagcaauu

SEQ ID NO: 1586119 - RNA, 19 nt, Homo sapiens
uuauucagcuggagguguu

SEQ ID NO: 1586120 - RNA, 19 nt, Homo sapiens
gcaagagagcauccuaucu

SEQ ID NO: 1586121 - RNA, 19 nt, Homo sapiens
gaauucugcccuccauuag

SEQ ID NO: 1586122 - RNA, 19 nt, Homo sapiens
ggcaaagcaauccaauaaa

SEQ ID NO: 1586123 - RNA, 19 nt, Homo sapiens
aguggaaccgucugucuua

SEQ ID NO: 1586124 - RNA, 19 nt, Homo sapiens
gacccugccugaaaacuuu

SEQ ID NO: 1586125 - RNA, 19 nt, Homo sapiens
ggacuccuaucaucaugcu

SEQ ID NO: 1586126 - RNA, 19 nt, Homo sapiens
gacccugccucaaaacuuu

SEQ ID NO: 1586127 - RNA, 19 nt, Homo sapiens
gugggauaauuuccucauu

SEQ ID NO: 1586128 - RNA, 19 nt, Homo sapiens
acccuccucucgccucuua

SEQ ID NO: 1586129 - RNA, 19 nt, Homo sapiens
auccuugucuucuccauuu

SEQ ID NO: 1586130 - RNA, 19 nt, Homo sapiens
cuucauuccuaccgucaaa

SEQ ID NO: 1586131 - RNA, 19 nt, Homo sapiens
aaaauaagcuaccugugau

SEQ ID NO: 1586132 - RNA, 19 nt, Homo sapiens
gccuuucccuuaccaagug

SEQ ID NO: 1586133 - RNA, 19 nt, Homo sapiens
cauuaggauuaucugcuuu

SEQ ID NO: 1586134 - RNA, 19 nt, Homo sapiens
acaagugcccucagcaaga

SEQ ID NO: 1586135 - RNA, 19 nt, Homo sapiens
gagccaggacuccaagugu

SEQ ID NO: 1586136 - RNA, 19 nt, Homo sapiens
gaaguguuauuggcaaagc

SEQ ID NO: 1586137 - RNA, 19 nt, Homo sapiens
caaugguguuucacaugga

SEQ ID NO: 1586138 - RNA, 19 nt, Homo sapiens
caaugguguuucacaugga

SEQ ID NO: 1586139 - RNA, 19 nt, Homo sapiens
agggaagucuccugagugu

SEQ ID NO: 1586140 - RNA, 19 nt, Homo sapiens
cacauaccuucacugcauu

SEQ ID NO: 1586141 - RNA, 19 nt, Homo sapiens
ucagcaagaagccguggua

SEQ ID NO: 1586142 - RNA, 19 nt, Homo sapiens
acacguaccuucgcugcau

SEQ ID NO: 1586143 - RNA, 19 nt, Homo sapiens
aagaaguguuauuggcaaa

SEQ ID NO: 1586144 - RNA, 19 nt, Homo sapiens
gaguguaagaaguguuauu

SEQ ID NO: 1586145 - RNA, 19 nt, Homo sapiens
cugaguguaagaaguguua

SEQ ID NO: 1586146 - RNA, 19 nt, Homo sapiens
gaagucuccugaguguaag

SEQ ID NO: 1586147 - RNA, 19 nt, Homo sapiens
gauccaaugguguuucaca

SEQ ID NO: 1586148 - RNA, 19 nt, Homo sapiens
gguggacccugccucaaaa

SEQ ID NO: 1586149 - RNA, 19 nt, Homo sapiens
ugguagacccugccugaaa

SEQ ID NO: 1586150 - RNA, 19 nt, Homo sapiens
cacauaccuucgcugcauu

SEQ ID NO: 1586151 - RNA, 19 nt, Homo sapiens
ggucggagcagagcaugga

SEQ ID NO: 1586152 - RNA, 19 nt, Homo sapiens
auucugcccuccauuagga

SEQ ID NO: 1586153 - RNA, 19 nt, Homo sapiens
gauuggucguuagguauuc

SEQ ID NO: 1586154 - RNA, 19 nt, Homo sapiens
gauaaguggaaccgucugu

SEQ ID NO: 1586155 - RNA, 19 nt, Homo sapiens
cagggcauggugacacaua

SEQ ID NO: 1586156 - RNA, 19 nt, Homo sapiens
cgaacucagccaccugcua

SEQ ID NO: 1586157 - RNA, 19 nt, Homo sapiens
agucuuggcuucacuuuug

SEQ ID NO: 1586158 - RNA, 19 nt, Homo sapiens
caggaggagcucaucuuug

SEQ ID NO: 1586159 - RNA, 19 nt, Homo sapiens
guacaccggagacugaucu

SEQ ID NO: 1586160 - RNA, 19 nt, Homo sapiens
agacacgugugacuguagu

SEQ ID NO: 1586161 - RNA, 19 nt, Homo sapiens
ccaggaggagcucaucuuc

SEQ ID NO: 1586162 - RNA, 19 nt, Homo sapiens
gguggacccugcccgaaaa

SEQ ID NO: 1586163 - RNA, 19 nt, Homo sapiens
ccaggaggagcucaucuuc

SEQ ID NO: 1586164 - RNA, 19 nt, Homo sapiens
agacaugaaagacacugaa

SEQ ID NO: 1586165 - RNA, 19 nt, Homo sapiens
gugauuggucguuagguau

SEQ ID NO: 1586166 - RNA, 19 nt, Homo sapiens
gucuuuggccuccaggaua

SEQ ID NO: 1586167 - RNA, 19 nt, Homo sapiens
aaugguguuucacauggaa

SEQ ID NO: 1586168 - RNA, 19 nt, Homo sapiens
acccucaccuccuucauuc

SEQ ID NO: 1586169 - RNA, 19 nt, Homo sapiens
ggagcuaccucaccacaaa

SEQ ID NO: 1586170 - RNA, 19 nt, Homo sapiens
gauaugacgucaauagaga

SEQ ID NO: 1586171 - RNA, 19 nt, Homo sapiens
caacaaagucuguaucuug

SEQ ID NO: 1586172 - RNA, 19 nt, Homo sapiens
ugaaacauuugccaacaua

SEQ ID NO: 1586173 - RNA, 19 nt, Homo sapiens
ggaagcaaaggaagauuua

SEQ ID NO: 1586174 - RNA, 19 nt, Homo sapiens
gaaauuacagagagagaaa

SEQ ID NO: 1586175 - RNA, 19 nt, Homo sapiens
gaacaaugccgccaaacug

SEQ ID NO: 1586176 - RNA, 19 nt, Homo sapiens
gcuccuggcugcaaaguga

SEQ ID NO: 1586177 - RNA, 19 nt, Homo sapiens
gcacuacuuugcuccuaaa

SEQ ID NO: 1586178 - RNA, 19 nt, Homo sapiens
caacuucacuaugcuuauu

SEQ ID NO: 1586179 - RNA, 19 nt, Homo sapiens
agagaagggucauagcuaa

SEQ ID NO: 1586180 - RNA, 19 nt, Homo sapiens
gaccaaggaugcccucuuc

SEQ ID NO: 1586181 - RNA, 19 nt, Homo sapiens
ccaccuggguuucuacauu

SEQ ID NO: 1586182 - RNA, 19 nt, Homo sapiens
gcacuuacuugcgcacuau

SEQ ID NO: 1586183 - RNA, 19 nt, Homo sapiens
gaaggggacugaaauauuc

SEQ ID NO: 1586184 - RNA, 19 nt, Homo sapiens
gaagggucauagcuaaaug

SEQ ID NO: 1586185 - RNA, 19 nt, Homo sapiens
ugacagaauucucagugaa

SEQ ID NO: 1586186 - RNA, 19 nt, Homo sapiens
gagagaagggucauagcua

SEQ ID NO: 1586187 - RNA, 19 nt, Homo sapiens
gcauagauccgacgucugu

SEQ ID NO: 1586188 - RNA, 19 nt, Homo sapiens
cagauagacugcugguuug

SEQ ID NO: 1586189 - RNA, 19 nt, Homo sapiens
ggacauccagguucuaaau

SEQ ID NO: 1586190 - RNA, 19 nt, Homo sapiens
ggaaggaccacuugauauc

SEQ ID NO: 1586191 - RNA, 19 nt, Homo sapiens
uugggagacuuuaucauua

SEQ ID NO: 1586192 - RNA, 19 nt, Homo sapiens
gcaacaaagucuguaucuu

SEQ ID NO: 1586193 - RNA, 19 nt, Homo sapiens
ggaagcugguggacaggaa

SEQ ID NO: 1586194 - RNA, 19 nt, Homo sapiens
ucagugaagucuaccauca

SEQ ID NO: 1586195 - RNA, 19 nt, Homo sapiens
gcucggagaucaucauugc

SEQ ID NO: 1586196 - RNA, 19 nt, Homo sapiens
ccucagcuccuggcaauua

SEQ ID NO: 1586197 - RNA, 19 nt, Homo sapiens
ggccaagucugcaucuuca

SEQ ID NO: 1586198 - RNA, 19 nt, Homo sapiens
cauuagauaugacgucaau

SEQ ID NO: 1586199 - RNA, 19 nt, Homo sapiens
ccauaccagccaagaauua

SEQ ID NO: 1586200 - RNA, 19 nt, Homo sapiens
gaugcccucuucacaauuc

SEQ ID NO: 1586201 - RNA, 19 nt, Homo sapiens
gcgagggccuuuccagcaa

SEQ ID NO: 1586202 - RNA, 19 nt, Homo sapiens
acaagaaacagcgcacuua

SEQ ID NO: 1586203 - RNA, 19 nt, Homo sapiens
ggacauugaguuccagaug

SEQ ID NO: 1586204 - RNA, 19 nt, Homo sapiens
caaauggccacaagaaaca

SEQ ID NO: 1586205 - RNA, 19 nt, Homo sapiens
guacaacaagccaggauug

SEQ ID NO: 1586206 - RNA, 19 nt, Homo sapiens
gaaaagaagaguggugaua

SEQ ID NO: 1586207 - RNA, 19 nt, Homo sapiens
gaaacagcgcacuuacuug

SEQ ID NO: 1586208 - RNA, 19 nt, Homo sapiens
ucaggcuccucaacaagua

SEQ ID NO: 1586209 - RNA, 19 nt, Homo sapiens
gaauaaaaccacagaagaa

SEQ ID NO: 1586210 - RNA, 19 nt, Homo sapiens
agaaacagcgcacuuacuu

SEQ ID NO: 1586211 - RNA, 19 nt, Homo sapiens
gcacgcagccaggaccuuu

SEQ ID NO: 1586212 - RNA, 19 nt, Homo sapiens
gaaggaccacuugauauca

SEQ ID NO: 1586213 - RNA, 19 nt, Homo sapiens
gcugcaaagugacgaugaa

SEQ ID NO: 1586214 - RNA, 19 nt, Homo sapiens
ccaucaggcuccucaacaa

SEQ ID NO: 1586215 - RNA, 19 nt, Homo sapiens
gggcgaaauuacagagaga

SEQ ID NO: 1586216 - RNA, 19 nt, Homo sapiens
caggaacaaugccgccaaa

SEQ ID NO: 1586217 - RNA, 19 nt, Homo sapiens
gaaacauuugccaacauaa

SEQ ID NO: 1586218 - RNA, 19 nt, Homo sapiens
cuaccaucauuucccguua

SEQ ID NO: 1586219 - RNA, 19 nt, Homo sapiens
gagaagggucauagcuaaa

SEQ ID NO: 1586220 - RNA, 19 nt, Homo sapiens
caccuggguuucuacauug

SEQ ID NO: 1586221 - RNA, 19 nt, Homo sapiens
cagcaacaguaagaaauuc

SEQ ID NO: 1586222 - RNA, 19 nt, Homo sapiens
gcgggaagccugagugcaa

SEQ ID NO: 1586223 - RNA, 19 nt, Homo sapiens
ucaccauccucaucaacaa

SEQ ID NO: 1586224 - RNA, 19 nt, Homo sapiens
cacagugaacggagaguua

SEQ ID NO: 1586225 - RNA, 19 nt, Homo sapiens
gcaacgacguggacuucag

SEQ ID NO: 1586226 - RNA, 19 nt, Homo sapiens
caggaccguuucaguauca

SEQ ID NO: 1586227 - RNA, 19 nt, Homo sapiens
gagcagagucaucuuggau

SEQ ID NO: 1586228 - RNA, 19 nt, Homo sapiens
gggagacuuuaucauuaga

SEQ ID NO: 1586229 - RNA, 19 nt, Homo sapiens
uuucuguucuguuagcaua

SEQ ID NO: 1586230 - RNA, 19 nt, Homo sapiens
ccagcaacaguaagaaauu

SEQ ID NO: 1586231 - RNA, 19 nt, Homo sapiens
gaaaguguacauucaccau

SEQ ID NO: 1586232 - RNA, 19 nt, Homo sapiens
gaugggaaaguguacauuc

SEQ ID NO: 1586233 - RNA, 19 nt, Homo sapiens
ggaauaaaaccacagaaga

SEQ ID NO: 1586234 - RNA, 19 nt, Homo sapiens
gacaccaccuggguuucua

SEQ ID NO: 1586235 - RNA, 19 nt, Homo sapiens
ccaaauggccacaagaaac

SEQ ID NO: 1586236 - RNA, 19 nt, Homo sapiens
agugaagucuaccaucauu

SEQ ID NO: 1586237 - RNA, 19 nt, Homo sapiens
ccaaccggaucaaaguaug

SEQ ID NO: 1586238 - RNA, 19 nt, Homo sapiens
ccaggaccuuugcucaaga

SEQ ID NO: 1586239 - RNA, 19 nt, Homo sapiens
guaagaaauucaucauccu

SEQ ID NO: 1586240 - RNA, 19 nt, Homo sapiens
aaguguacauucaccauau

SEQ ID NO: 1586241 - RNA, 19 nt, Homo sapiens
caauagagaacagagcauu

SEQ ID NO: 1586242 - RNA, 19 nt, Homo sapiens
caucuacugucauuaacca

SEQ ID NO: 1586243 - RNA, 19 nt, Homo sapiens
aaagaagaguggugauagg

SEQ ID NO: 1586244 - RNA, 19 nt, Homo sapiens
ggaacaaugccgccaaacu

SEQ ID NO: 1586245 - RNA, 19 nt, Homo sapiens
cagcuuucaucaccaacuu

SEQ ID NO: 1586246 - RNA, 19 nt, Homo sapiens
cagggacucuggugucaca

SEQ ID NO: 1586247 - RNA, 19 nt, Homo sapiens
ugaagucuaccaucauuuc

SEQ ID NO: 1586248 - RNA, 19 nt, Homo sapiens
aaccuuugaugacagaauu

SEQ ID NO: 1586249 - RNA, 19 nt, Homo sapiens
cugaagaccaggacauuga

SEQ ID NO: 1586250 - RNA, 19 nt, Homo sapiens
uaaaugcaacaaagucugu

SEQ ID NO: 1586251 - RNA, 19 nt, Homo sapiens
ccucauccaccucuacaaa

SEQ ID NO: 1586252 - RNA, 19 nt, Homo sapiens
caggaccuuugcucaagaa

SEQ ID NO: 1586253 - RNA, 19 nt, Homo sapiens
gccaggaccuuugcucaag

SEQ ID NO: 1586254 - RNA, 19 nt, Homo sapiens
aaaguguacauucaccaua

SEQ ID NO: 1586255 - RNA, 19 nt, Homo sapiens
caaggaugcccucuucaca

SEQ ID NO: 1586256 - RNA, 19 nt, Homo sapiens
ugggagacuuuaucauuag

SEQ ID NO: 1586257 - RNA, 19 nt, Homo sapiens
caaugccgccaaacugauu

SEQ ID NO: 1586258 - RNA, 19 nt, Homo sapiens
ucaacaagccagagagauc

SEQ ID NO: 1586259 - RNA, 19 nt, Homo sapiens
ugacauccgcaucgauuau

SEQ ID NO: 1586260 - RNA, 19 nt, Homo sapiens
ggaucaaaguauggaagga

SEQ ID NO: 1586261 - RNA, 19 nt, Homo sapiens
gcaaguacgagcacagcau

SEQ ID NO: 1586262 - RNA, 19 nt, Homo sapiens
ggagagaagggucauagcu

SEQ ID NO: 1586263 - RNA, 19 nt, Homo sapiens
ccuggcaucccauccauuu

SEQ ID NO: 1586264 - RNA, 19 nt, Homo sapiens
cauaccagccaagaauuaa

SEQ ID NO: 1586265 - RNA, 19 nt, Homo sapiens
gucugcaucuucaccauug

SEQ ID NO: 1586266 - RNA, 19 nt, Homo sapiens
gaccguuucaguaucauug

SEQ ID NO: 1586267 - RNA, 19 nt, Homo sapiens
aggaugcccucuucacaau

SEQ ID NO: 1586268 - RNA, 19 nt, Homo sapiens
uuagauaugacgucaauag

SEQ ID NO: 1586269 - RNA, 19 nt, Homo sapiens
ucaagucugugauguauua

SEQ ID NO: 1586270 - RNA, 19 nt, Homo sapiens
ggaauaaucaccugcuuua

SEQ ID NO: 1586271 - RNA, 19 nt, Homo sapiens
gcaaaggccuuccugcauu

SEQ ID NO: 1586272 - RNA, 19 nt, Homo sapiens
gaucauuucucucuauuug

SEQ ID NO: 1586273 - RNA, 19 nt, Homo sapiens
gaacacagaggaauaauca

SEQ ID NO: 1586274 - RNA, 19 nt, Homo sapiens
ggauacaaaugaagcuuaa

SEQ ID NO: 1586275 - RNA, 19 nt, Homo sapiens
gauaggaaaugaugggauu

SEQ ID NO: 1586276 - RNA, 19 nt, Homo sapiens
gcacuaggauacaaaugaa

SEQ ID NO: 1586277 - RNA, 19 nt, Homo sapiens
cauauuugcuguucaaguu

SEQ ID NO: 1586278 - RNA, 19 nt, Homo sapiens
caaaggccuuccugcauuu

SEQ ID NO: 1586279 - RNA, 19 nt, Homo sapiens
gagaacaccugcaggaagu

SEQ ID NO: 1586280 - RNA, 19 nt, Homo sapiens
guaaggagaggauuaggua

SEQ ID NO: 1586281 - RNA, 19 nt, Homo sapiens
ggaagaugccagaaacuuu

SEQ ID NO: 1586282 - RNA, 19 nt, Homo sapiens
ggagaggauuagguacuua

SEQ ID NO: 1586283 - RNA, 19 nt, Homo sapiens
guacuuaggagcaaagaaa

SEQ ID NO: 1586284 - RNA, 19 nt, Homo sapiens
gcagaacacagaggaauaa

SEQ ID NO: 1586285 - RNA, 19 nt, Homo sapiens
uuuggucucucucuaauua

SEQ ID NO: 1586286 - RNA, 19 nt, Homo sapiens
gcagagagcgcagcauauu

SEQ ID NO: 1586287 - RNA, 19 nt, Homo sapiens
uuaaauggauccugauugu

SEQ ID NO: 1586288 - RNA, 19 nt, Homo sapiens
ggaagugaaucaagaugca

SEQ ID NO: 1586289 - RNA, 19 nt, Homo sapiens
gaugaucccuaacauacug

SEQ ID NO: 1586290 - RNA, 19 nt, Homo sapiens
agaaagaaguagcuuggaa

SEQ ID NO: 1586291 - RNA, 19 nt, Homo sapiens
ccaccuauuucccuggaua

SEQ ID NO: 1586292 - RNA, 19 nt, Homo sapiens
gagaugaucccuaacauac

SEQ ID NO: 1586293 - RNA, 19 nt, Homo sapiens
gguaauucaucuugguuug

SEQ ID NO: 1586294 - RNA, 19 nt, Homo sapiens
uaacauacuguacuacuug

SEQ ID NO: 1586295 - RNA, 19 nt, Homo sapiens
gaaagcacuaggauacaaa

SEQ ID NO: 1586296 - RNA, 19 nt, Homo sapiens
uaaagguguugucacugua

SEQ ID NO: 1586297 - RNA, 19 nt, Homo sapiens
aaauaucucuuguguagca

SEQ ID NO: 1586298 - RNA, 19 nt, Homo sapiens
cuaaagguguugucacugu

SEQ ID NO: 1586299 - RNA, 19 nt, Homo sapiens
caucuugguuugcuauguu

SEQ ID NO: 1586300 - RNA, 19 nt, Homo sapiens
ggauuuggucucucucuaa

SEQ ID NO: 1586301 - RNA, 19 nt, Homo sapiens
gggaguaaggagaggauua

SEQ ID NO: 1586302 - RNA, 19 nt, Homo sapiens
gcacauaauccauauuugc

SEQ ID NO: 1586303 - RNA, 19 nt, Homo sapiens
gaccaaggcugaagcuacu

SEQ ID NO: 1586304 - RNA, 19 nt, Homo sapiens
gugaugcuccuccaccuua

SEQ ID NO: 1586305 - RNA, 19 nt, Homo sapiens
guuccuagguguaaaauuu

SEQ ID NO: 1586306 - RNA, 19 nt, Homo sapiens
gaaucaagaugcagaacac

SEQ ID NO: 1586307 - RNA, 19 nt, Homo sapiens
gauuuggucucucucuaau

SEQ ID NO: 1586308 - RNA, 19 nt, Homo sapiens
ccuaagggauucuaaaggu

SEQ ID NO: 1586309 - RNA, 19 nt, Homo sapiens
uaugaauucucucucaaga

SEQ ID NO: 1586310 - RNA, 19 nt, Homo sapiens
gaggauuuaucaauuaugc

SEQ ID NO: 1586311 - RNA, 19 nt, Homo sapiens
gaagaagagucuggagaac

SEQ ID NO: 1586312 - RNA, 19 nt, Homo sapiens
ggguuauaauguagaauga

SEQ ID NO: 1586313 - RNA, 19 nt, Homo sapiens
cauuuaagguguggucaaa

SEQ ID NO: 1586314 - RNA, 19 nt, Homo sapiens
gggcagucuugcuuuauuc

SEQ ID NO: 1586315 - RNA, 19 nt, Homo sapiens
gaauaaucaccugcuuuaa

SEQ ID NO: 1586316 - RNA, 19 nt, Homo sapiens
acaauucugcgguaccuua

SEQ ID NO: 1586317 - RNA, 19 nt, Homo sapiens
gaggaauaaucaccugcuu

SEQ ID NO: 1586318 - RNA, 19 nt, Homo sapiens
ugaagaagagucuggagaa

SEQ ID NO: 1586319 - RNA, 19 nt, Homo sapiens
ugagaugaucccuaacaua

SEQ ID NO: 1586320 - RNA, 19 nt, Homo sapiens
agaaagcacuaggauacaa

SEQ ID NO: 1586321 - RNA, 19 nt, Homo sapiens
ucuugacacucuuucuaua

SEQ ID NO: 1586322 - RNA, 19 nt, Homo sapiens
gcaaaaucauagugcaaaa

SEQ ID NO: 1586323 - RNA, 19 nt, Homo sapiens
cuaacauacuguacuacuu

SEQ ID NO: 1586324 - RNA, 19 nt, Homo sapiens
uagccuguauucacaauuc

SEQ ID NO: 1586325 - RNA, 19 nt, Homo sapiens
uuaaagggguuuucucaaa

SEQ ID NO: 1586326 - RNA, 19 nt, Homo sapiens
cucagaggauuuaucaauu

SEQ ID NO: 1586327 - RNA, 19 nt, Homo sapiens
ucauggcauuccucuuuaa

SEQ ID NO: 1586328 - RNA, 19 nt, Homo sapiens
aaauggauccugauuguca

SEQ ID NO: 1586329 - RNA, 19 nt, Homo sapiens
gaugggauuuucauguuaa

SEQ ID NO: 1586330 - RNA, 19 nt, Homo sapiens
ugaacaggcugcaggugau

SEQ ID NO: 1586331 - RNA, 19 nt, Homo sapiens
uacaauguguuagcagaaa

SEQ ID NO: 1586332 - RNA, 19 nt, Homo sapiens
ggccaaagucugggaguaa

SEQ ID NO: 1586333 - RNA, 19 nt, Homo sapiens
guaccuaagggauucuaaa

SEQ ID NO: 1586334 - RNA, 19 nt, Homo sapiens
gaacaccugcaggaaguga

SEQ ID NO: 1586335 - RNA, 19 nt, Homo sapiens
uuucauggcauuccucuuu

SEQ ID NO: 1586336 - RNA, 19 nt, Homo sapiens
acagaaagcacuaggauac

SEQ ID NO: 1586337 - RNA, 19 nt, Homo sapiens
aaacagaaagcacuaggau

SEQ ID NO: 1586338 - RNA, 19 nt, Homo sapiens
auacuguacuacuugcuuu

SEQ ID NO: 1586339 - RNA, 19 nt, Homo sapiens
ucccuaacauacuguacua

SEQ ID NO: 1586340 - RNA, 19 nt, Homo sapiens
gcaaagaaagaaguagcuu

SEQ ID NO: 1586341 - RNA, 19 nt, Homo sapiens
augaacaccuggaagcaaa

SEQ ID NO: 1586342 - RNA, 19 nt, Homo sapiens
uaccagcaguugcagaaug

SEQ ID NO: 1586343 - RNA, 19 nt, Homo sapiens
gcaguugcagaaugaagaa

SEQ ID NO: 1586344 - RNA, 19 nt, Homo sapiens
ggaguaaggagaggauuag

SEQ ID NO: 1586345 - RNA, 19 nt, Homo sapiens
guaauucuugacacucuuu

SEQ ID NO: 1586346 - RNA, 19 nt, Homo sapiens
cagagagcgcagcauauuu

SEQ ID NO: 1586347 - RNA, 19 nt, Homo sapiens
gcaggaagugaaucaagau

SEQ ID NO: 1586348 - RNA, 19 nt, Homo sapiens
ugcaggaagugaaucaaga

SEQ ID NO: 1586349 - RNA, 19 nt, Homo sapiens
ucucagaggauuuaucaau

SEQ ID NO: 1586350 - RNA, 19 nt, Homo sapiens
cagcauauuuugacuacaa

SEQ ID NO: 1586351 - RNA, 19 nt, Homo sapiens
uggcauuccucuuuaacug

SEQ ID NO: 1586352 - RNA, 19 nt, Homo sapiens
caaggaugagucuggguuu

SEQ ID NO: 1586353 - RNA, 19 nt, Homo sapiens
gguaccagcaguugcagaa

SEQ ID NO: 1586354 - RNA, 19 nt, Homo sapiens
ucaagaugcagaacacaga

SEQ ID NO: 1586355 - RNA, 19 nt, Homo sapiens
uucauggcauuccucuuua

SEQ ID NO: 1586356 - RNA, 19 nt, Homo sapiens
uuuauagccuguauucaca

SEQ ID NO: 1586357 - RNA, 19 nt, Homo sapiens
cuuccugcauuuaugaauu

SEQ ID NO: 1586358 - RNA, 19 nt, Homo sapiens
gaacaggcugcaggugaug

SEQ ID NO: 1586359 - RNA, 19 nt, Homo sapiens
ugaagcuacuaucccuuug

SEQ ID NO: 1586360 - RNA, 19 nt, Homo sapiens
guucggaagaugccagaaa

SEQ ID NO: 1586361 - RNA, 19 nt, Homo sapiens
gcagaaugaagaagagucu

SEQ ID NO: 1586362 - RNA, 19 nt, Homo sapiens
ccaccuuacagcagcauuu

SEQ ID NO: 1586363 - RNA, 19 nt, Homo sapiens
cauugaaucauuagugguu

SEQ ID NO: 1586364 - RNA, 19 nt, Homo sapiens
uuuaggcuuucuccuguuu

SEQ ID NO: 1586365 - RNA, 19 nt, Homo sapiens
gcuuggaacuuuugagaug

SEQ ID NO: 1586366 - RNA, 19 nt, Homo sapiens
accagcaguugcagaauga

SEQ ID NO: 1586367 - RNA, 19 nt, Homo sapiens
aagguguugucacuguaua

SEQ ID NO: 1586368 - RNA, 19 nt, Homo sapiens
auucugcgguaccuuauug

SEQ ID NO: 1586369 - RNA, 19 nt, Homo sapiens
gagagccgcuugcgacuua

SEQ ID NO: 1586370 - RNA, 19 nt, Homo sapiens
gagccuacauccagaauga

SEQ ID NO: 1586371 - RNA, 19 nt, Homo sapiens
uaauaaagcggauucuaga

SEQ ID NO: 1586372 - RNA, 19 nt, Homo sapiens
gcuuugagcuggugggaau

SEQ ID NO: 1586373 - RNA, 19 nt, Homo sapiens
cggcugcgguugagacuga

SEQ ID NO: 1586374 - RNA, 19 nt, Homo sapiens
ccucagcaccugccacuuu

SEQ ID NO: 1586375 - RNA, 19 nt, Homo sapiens
ccaccauauuugagucuuu

SEQ ID NO: 1586376 - RNA, 19 nt, Homo sapiens
ggaaucaguggauaucaca

SEQ ID NO: 1586377 - RNA, 19 nt, Homo sapiens
ggacaaccaagaccaaagg

SEQ ID NO: 1586378 - RNA, 19 nt, Homo sapiens
gauaucacaggcuaaagga

SEQ ID NO: 1586379 - RNA, 19 nt, Homo sapiens
gagugccgcugacagaagu

SEQ ID NO: 1586380 - RNA, 19 nt, Homo sapiens
cauaauaaagcggauucua

SEQ ID NO: 1586381 - RNA, 19 nt, Homo sapiens
ggauaucacaggcuaaagg

SEQ ID NO: 1586382 - RNA, 19 nt, Homo sapiens
gaccaaaggacacaguuac

SEQ ID NO: 1586383 - RNA, 19 nt, Homo sapiens
agaccaaaggacacaguua

SEQ ID NO: 1586384 - RNA, 19 nt, Homo sapiens
cggcaucuccuuccacaga

SEQ ID NO: 1586385 - RNA, 19 nt, Homo sapiens
caccauauuugagucuuuc

SEQ ID NO: 1586386 - RNA, 19 nt, Homo sapiens
gggaaucaguggauaucac

SEQ ID NO: 1586387 - RNA, 19 nt, Homo sapiens
auaauaaagcggauucuag

SEQ ID NO: 1586388 - RNA, 19 nt, Homo sapiens
gcagcgccuuacucuggaa

SEQ ID NO: 1586389 - RNA, 19 nt, Homo sapiens
uccacagacuucccaagaa

SEQ ID NO: 1586390 - RNA, 19 nt, Homo sapiens
cugcugaugucaccugcuu

SEQ ID NO: 1586391 - RNA, 19 nt, Homo sapiens
gcugaugucaccugcuuuc

SEQ ID NO: 1586392 - RNA, 19 nt, Homo sapiens
cuucugcuccaaacacuuu

SEQ ID NO: 1586393 - RNA, 19 nt, Homo sapiens
gguugagacugaccaagcu

SEQ ID NO: 1586394 - RNA, 19 nt, Homo sapiens
guggauaucacaggcuaaa

SEQ ID NO: 1586395 - RNA, 19 nt, Homo sapiens
gagcaugugcaggacuuug

SEQ ID NO: 1586396 - RNA, 19 nt, Homo sapiens
uugagucuuucuccaaguu

SEQ ID NO: 1586397 - RNA, 19 nt, Homo sapiens
cucagcaccugccacuuug

SEQ ID NO: 1586398 - RNA, 19 nt, Homo sapiens
ggagagccgcuugcgacuu

SEQ ID NO: 1586399 - RNA, 19 nt, Homo sapiens
caucuacuucugcuccaaa

SEQ ID NO: 1586400 - RNA, 19 nt, Homo sapiens
gaagcgggcacaggcagau

SEQ ID NO: 1586401 - RNA, 19 nt, Homo sapiens
acuuaacucccgccucuuu

SEQ ID NO: 1586402 - RNA, 19 nt, Homo sapiens
ggugggaaucaguggauau

SEQ ID NO: 1586403 - RNA, 19 nt, Homo sapiens
gaaauuauccaaagcauca

SEQ ID NO: 1586404 - RNA, 19 nt, Homo sapiens
gcaaagaacucccgugacu

SEQ ID NO: 1586405 - RNA, 19 nt, Homo sapiens
gagaaggcauuguauaugg

SEQ ID NO: 1586406 - RNA, 19 nt, Homo sapiens
ccgagaagaugcuccagua

SEQ ID NO: 1586407 - RNA, 19 nt, Homo sapiens
gaagcaauuccaugaguaa

SEQ ID NO: 1586408 - RNA, 19 nt, Homo sapiens
agaaagcagugaagcaauu

SEQ ID NO: 1586409 - RNA, 19 nt, Homo sapiens
gcgguuaccucccacagaa

SEQ ID NO: 1586410 - RNA, 19 nt, Homo sapiens
gaagugggaugagaaugug

SEQ ID NO: 1586411 - RNA, 19 nt, Homo sapiens
ugaagcaauuccaugagua

SEQ ID NO: 1586412 - RNA, 19 nt, Homo sapiens
gaggagaaggcauuguaua

SEQ ID NO: 1586413 - RNA, 19 nt, Homo sapiens
ggagaaggcauuguauaug

SEQ ID NO: 1586414 - RNA, 19 nt, Homo sapiens
gcaauuccaugaguaaugc

SEQ ID NO: 1586415 - RNA, 19 nt, Homo sapiens
gaaucaucaucgccacuga

SEQ ID NO: 1586416 - RNA, 19 nt, Homo sapiens
gcagaggccuguguucacu

SEQ ID NO: 1586417 - RNA, 19 nt, Homo sapiens
gugaagcaauuccaugagu

SEQ ID NO: 1586418 - RNA, 19 nt, Homo sapiens
aaagaacucccgugacuca

SEQ ID NO: 1586419 - RNA, 19 nt, Homo sapiens
cgagugaagugggaugaga

SEQ ID NO: 1586420 - RNA, 19 nt, Homo sapiens
gaagccagguuuugugaga

SEQ ID NO: 1586421 - RNA, 19 nt, Homo sapiens
aaacuccaucugccuguua

SEQ ID NO: 1586422 - RNA, 19 nt, Homo sapiens
caugaguaaugcuaucguu

SEQ ID NO: 1586423 - RNA, 19 nt, Homo sapiens
guaccgaggagaaggcauu

SEQ ID NO: 1586424 - RNA, 19 nt, Homo sapiens
gcacgcagaggccuguguu

SEQ ID NO: 1586425 - RNA, 19 nt, Homo sapiens
gaaggcguaccgaggagaa

SEQ ID NO: 1586426 - RNA, 19 nt, Homo sapiens
gaaagcagugaagcaauuc

SEQ ID NO: 1586427 - RNA, 19 nt, Homo sapiens
guuggaggccuacgaguga

SEQ ID NO: 1586428 - RNA, 19 nt, Homo sapiens
ccgaggagaaggcauugua

SEQ ID NO: 1586429 - RNA, 19 nt, Homo sapiens
ugaagugggaugagaaugu

SEQ ID NO: 1586430 - RNA, 19 nt, Homo sapiens
acucaggguuggcguguga

SEQ ID NO: 1586431 - RNA, 19 nt, Homo sapiens
ccauguggagcauccguua

SEQ ID NO: 1586432 - RNA, 19 nt, Homo sapiens
ucagaaagcagugaagcaa

SEQ ID NO: 1586433 - RNA, 19 nt, Homo sapiens
cauuguauaugggacacua

SEQ ID NO: 1586434 - RNA, 19 nt, Homo sapiens
augagaaugugaccgguuu

SEQ ID NO: 1586435 - RNA, 19 nt, Homo sapiens
caaacuccaucugccuguu

SEQ ID NO: 1586436 - RNA, 19 nt, Homo sapiens
cuggucacauucuuccaua

SEQ ID NO: 1586437 - RNA, 19 nt, Homo sapiens
cagugaagcaauuccauga

SEQ ID NO: 1586438 - RNA, 19 nt, Homo sapiens
aggagaaggcauuguauau

SEQ ID NO: 1586439 - RNA, 19 nt, Homo sapiens
ggccuguguucacucuuug

SEQ ID NO: 1586440 - RNA, 19 nt, Homo sapiens
aggccuguguucacucuuu

SEQ ID NO: 1586441 - RNA, 19 nt, Homo sapiens
gagugaagugggaugagaa

SEQ ID NO: 1586442 - RNA, 19 nt, Homo sapiens
gaaugugaccgguuuugaa

SEQ ID NO: 1586443 - RNA, 19 nt, Homo sapiens
caaccuggucacauucuuc

SEQ ID NO: 1586444 - RNA, 19 nt, Homo sapiens
ccaaccuggucacauucuu

SEQ ID NO: 1586445 - RNA, 19 nt, Homo sapiens
ccauucauguguuccaaac

SEQ ID NO: 1586446 - RNA, 19 nt, Homo sapiens
cgaggagaaggcauuguau

SEQ ID NO: 1586447 - RNA, 19 nt, Homo sapiens
ccagagauuuuguggacuu

SEQ ID NO: 1586448 - RNA, 19 nt, Homo sapiens
cagaaagcagugaagcaau

SEQ ID NO: 1586449 - RNA, 19 nt, Homo sapiens
agaacgugguggacuccuu

SEQ ID NO: 1586450 - RNA, 19 nt, Homo sapiens
gggaacccaccaagaccaa

SEQ ID NO: 1586451 - RNA, 19 nt, Homo sapiens
cauaggcgcuguucucuua

SEQ ID NO: 1586452 - RNA, 19 nt, Homo sapiens
ggaacaagcugguguagau

SEQ ID NO: 1586453 - RNA, 19 nt, Homo sapiens
caaaguaccugcucacugu

SEQ ID NO: 1586454 - RNA, 19 nt, Homo sapiens
ugacauugcucuuugguaa

SEQ ID NO: 1586455 - RNA, 19 nt, Homo sapiens
gaagugcccucuccucgaa

SEQ ID NO: 1586456 - RNA, 19 nt, Homo sapiens
ggaaagggagggaugaauu

SEQ ID NO: 1586457 - RNA, 19 nt, Homo sapiens
ugaaagcuuugaagaugua

SEQ ID NO: 1586458 - RNA, 19 nt, Homo sapiens
agaccucagucaccuauua

SEQ ID NO: 1586459 - RNA, 19 nt, Homo sapiens
gaaagggagggaugaauug

SEQ ID NO: 1586460 - RNA, 19 nt, Homo sapiens
guaggacacucuucugaug

SEQ ID NO: 1586461 - RNA, 19 nt, Homo sapiens
ucacaacuuucuguucaua

SEQ ID NO: 1586462 - RNA, 19 nt, Homo sapiens
ggguuuaauuccugaagua

SEQ ID NO: 1586463 - RNA, 19 nt, Homo sapiens
ugaguacccuuauauuuca

SEQ ID NO: 1586464 - RNA, 19 nt, Homo sapiens
gcgcuguucucuuagguuu

SEQ ID NO: 1586465 - RNA, 19 nt, Homo sapiens
gcaaagcgcaacuccuuga

SEQ ID NO: 1586466 - RNA, 19 nt, Homo sapiens
gauagaacccuggugaauu

SEQ ID NO: 1586467 - RNA, 19 nt, Homo sapiens
gagaaggcaccaaagcuuu

SEQ ID NO: 1586468 - RNA, 19 nt, Homo sapiens
gaacccuggugaauucaga

SEQ ID NO: 1586469 - RNA, 19 nt, Homo sapiens
ggccagacaucaccucaga

SEQ ID NO: 1586470 - RNA, 19 nt, Homo sapiens
gaggaggccuugcugaagu

SEQ ID NO: 1586471 - RNA, 19 nt, Homo sapiens
cuaaagcaguacuacauug

SEQ ID NO: 1586472 - RNA, 19 nt, Homo sapiens
ggauaggaguuuagagaag

SEQ ID NO: 1586473 - RNA, 19 nt, Homo sapiens
caugaguacccuuauauuu

SEQ ID NO: 1586474 - RNA, 19 nt, Homo sapiens
ucacugguuuccaugagua

SEQ ID NO: 1586475 - RNA, 19 nt, Homo sapiens
gagaguucaugacaacaga

SEQ ID NO: 1586476 - RNA, 19 nt, Homo sapiens
cagcauggccuucuguuug

SEQ ID NO: 1586477 - RNA, 19 nt, Homo sapiens
auagaacccuggugaauuc

SEQ ID NO: 1586478 - RNA, 19 nt, Homo sapiens
guacuacauuggugauauc

SEQ ID NO: 1586479 - RNA, 19 nt, Homo sapiens
ccuggugaauucagaguaa

SEQ ID NO: 1586480 - RNA, 19 nt, Homo sapiens
agucuaguguugaaaguuu

SEQ ID NO: 1586481 - RNA, 19 nt, Homo sapiens
agugaaagcuuugaagaug

SEQ ID NO: 1586482 - RNA, 19 nt, Homo sapiens
gcuaaagcaguacuacauu

SEQ ID NO: 1586483 - RNA, 19 nt, Homo sapiens
caagugaaagcuuugaaga

SEQ ID NO: 1586484 - RNA, 19 nt, Homo sapiens
ugaaggaacuguggcuugu

SEQ ID NO: 1586485 - RNA, 19 nt, Homo sapiens
gaauucagaguaaucuuuc

SEQ ID NO: 1586486 - RNA, 19 nt, Homo sapiens
gugaaagcuuugaagaugu

SEQ ID NO: 1586487 - RNA, 19 nt, Homo sapiens
ucucuuagguuuccuguac

SEQ ID NO: 1586488 - RNA, 19 nt, Homo sapiens
gacuccaacuuguggguuu

SEQ ID NO: 1586489 - RNA, 19 nt, Homo sapiens
aaggaacuguggcuuguga

SEQ ID NO: 1586490 - RNA, 19 nt, Homo sapiens
caggauaggaguuuagaga

SEQ ID NO: 1586491 - RNA, 19 nt, Homo sapiens
ccucgaauccugccaguug

SEQ ID NO: 1586492 - RNA, 19 nt, Homo sapiens
cuacacaucggaaagcaaa

SEQ ID NO: 1586493 - RNA, 19 nt, Homo sapiens
cgagcacccuggaggagaa

SEQ ID NO: 1586494 - RNA, 19 nt, Homo sapiens
ccuccucccuuucaagcua

SEQ ID NO: 1586495 - RNA, 19 nt, Homo sapiens
gcagucuaguguugaaagu

SEQ ID NO: 1586496 - RNA, 19 nt, Homo sapiens
auagugacauugcucuuug

SEQ ID NO: 1586497 - RNA, 19 nt, Homo sapiens
uuucacaacuuucuguuca

SEQ ID NO: 1586498 - RNA, 19 nt, Homo sapiens
caacagaccguuuuccauu

SEQ ID NO: 1586499 - RNA, 19 nt, Homo sapiens
cuacauuggugauauccau

SEQ ID NO: 1586500 - RNA, 19 nt, Homo sapiens
gauugcauauuagacauuc

SEQ ID NO: 1586501 - RNA, 19 nt, Homo sapiens
agaugcaagugaaagcuuu

SEQ ID NO: 1586502 - RNA, 19 nt, Homo sapiens
gaacaagcugguguagaug

SEQ ID NO: 1586503 - RNA, 19 nt, Homo sapiens
gcaagugaaagcuuugaag

SEQ ID NO: 1586504 - RNA, 19 nt, Homo sapiens
caagacgauuggccagaca

SEQ ID NO: 1586505 - RNA, 19 nt, Homo sapiens
aaagugagaguucaugaca

SEQ ID NO: 1586506 - RNA, 19 nt, Homo sapiens
gagcuuuaccaaggaguuu

SEQ ID NO: 1586507 - RNA, 19 nt, Homo sapiens
cagaguaaucuuucuuuag

SEQ ID NO: 1586508 - RNA, 19 nt, Homo sapiens
guggccaccuccucccuuu

SEQ ID NO: 1586509 - RNA, 19 nt, Homo sapiens
gcggcagucuaguguugaa

SEQ ID NO: 1586510 - RNA, 19 nt, Homo sapiens
gggcgagucuacgauguca

SEQ ID NO: 1586511 - RNA, 19 nt, Homo sapiens
uggcaaagcgcaacuccuu

SEQ ID NO: 1586512 - RNA, 19 nt, Homo sapiens
ccuguaauccuggcacuuu

SEQ ID NO: 1586513 - RNA, 19 nt, Homo sapiens
ucagagccuuacucccaaa

SEQ ID NO: 1586514 - RNA, 19 nt, Homo sapiens
ggcgaaaacuagagacuug

SEQ ID NO: 1586515 - RNA, 19 nt, Homo sapiens
gaccuuaaaccugaaagug

SEQ ID NO: 1586516 - RNA, 19 nt, Homo sapiens
gaaagugagaguucaugac

SEQ ID NO: 1586517 - RNA, 19 nt, Homo sapiens
gcuuuccaauacuuugauu

SEQ ID NO: 1586518 - RNA, 19 nt, Homo sapiens
uauagugacauugcucuuu

SEQ ID NO: 1586519 - RNA, 19 nt, Homo sapiens
acaacuuucuguucauaag

SEQ ID NO: 1586520 - RNA, 19 nt, Homo sapiens
ccaugaguacccuuauauu

SEQ ID NO: 1586521 - RNA, 19 nt, Homo sapiens
uuccaugaguacccuuaua

SEQ ID NO: 1586522 - RNA, 19 nt, Homo sapiens
caucauaggcgcuguucuc

SEQ ID NO: 1586523 - RNA, 19 nt, Homo sapiens
caagcuagggcagcaggua

SEQ ID NO: 1586524 - RNA, 19 nt, Homo sapiens
acuuaaaacugccaaauga

SEQ ID NO: 1586525 - RNA, 19 nt, Homo sapiens
gacauugcucuuugguaaa

SEQ ID NO: 1586526 - RNA, 19 nt, Homo sapiens
ugguguagaugcaagugaa

SEQ ID NO: 1586527 - RNA, 19 nt, Homo sapiens
agacaucaccucagaucug

SEQ ID NO: 1586528 - RNA, 19 nt, Homo sapiens
ccagacaucaccucagauc

SEQ ID NO: 1586529 - RNA, 19 nt, Homo sapiens
gaagucgagaccucaguca

SEQ ID NO: 1586530 - RNA, 19 nt, Homo sapiens
ggcaguauguccgguucaa

SEQ ID NO: 1586531 - RNA, 19 nt, Homo sapiens
gaaggcaccaaagcuuuca

SEQ ID NO: 1586532 - RNA, 19 nt, Homo sapiens
agagaaggcaccaaagcuu

SEQ ID NO: 1586533 - RNA, 19 nt, Homo sapiens
caguauguccgguucaaug

SEQ ID NO: 1586534 - RNA, 19 nt, Homo sapiens
gcuggaacaagcuggugua

SEQ ID NO: 1586535 - RNA, 19 nt, Homo sapiens
ucucuucacugguuuccau

SEQ ID NO: 1586536 - RNA, 19 nt, Homo sapiens
guuuagagaaggcaccaaa

SEQ ID NO: 1586537 - RNA, 19 nt, Homo sapiens
cuaaagaaacaggauagga

SEQ ID NO: 1586538 - RNA, 19 nt, Homo sapiens
gggaugaauuggggugaua

SEQ ID NO: 1586539 - RNA, 19 nt, Homo sapiens
aaaugccugcuuuccaaua

SEQ ID NO: 1586540 - RNA, 19 nt, Homo sapiens
ccagcauggccuucuguuu

SEQ ID NO: 1586541 - RNA, 19 nt, Homo sapiens
uguagagcuuuaccaagga

SEQ ID NO: 1586542 - RNA, 19 nt, Homo sapiens
ugauagaacccuggugaau

SEQ ID NO: 1586543 - RNA, 19 nt, Homo sapiens
gguuuaauuccugaaguaa

SEQ ID NO: 1586544 - RNA, 19 nt, Homo sapiens
caaagcgcaacuccuugaa

SEQ ID NO: 1586545 - RNA, 19 nt, Homo sapiens
aaaaguugcugggcauauu

SEQ ID NO: 1586546 - RNA, 19 nt, Homo sapiens
gaugccagagaaaugcuaa

SEQ ID NO: 1586547 - RNA, 19 nt, Homo sapiens
gguguuuccucucuucacu

SEQ ID NO: 1586548 - RNA, 19 nt, Homo sapiens
uaaagcaguacuacauugg

SEQ ID NO: 1586549 - RNA, 19 nt, Homo sapiens
ggaacuguggcuugugauc

SEQ ID NO: 1586550 - RNA, 19 nt, Homo sapiens
uaaguuauagugacauugc

SEQ ID NO: 1586551 - RNA, 19 nt, Homo sapiens
gagaaacccuauaaaugua

SEQ ID NO: 1586552 - RNA, 19 nt, Homo sapiens
gagaaacccuauaaaugua

SEQ ID NO: 1586553 - RNA, 19 nt, Homo sapiens
acacaaaguucuaaccuua

SEQ ID NO: 1586554 - RNA, 19 nt, Homo sapiens
gaucauaucucaacaacca

SEQ ID NO: 1586555 - RNA, 19 nt, Homo sapiens
ucagagaccucacaaaugu

SEQ ID NO: 1586556 - RNA, 19 nt, Homo sapiens
gagagaaacccuauaaaug

SEQ ID NO: 1586557 - RNA, 19 nt, Homo sapiens
gagagaaacccuauaaaug

SEQ ID NO: 1586558 - RNA, 19 nt, Homo sapiens
gagagaagcccuaugaaug

SEQ ID NO: 1586559 - RNA, 19 nt, Homo sapiens
ggagagaaacccuauaaau

SEQ ID NO: 1586560 - RNA, 19 nt, Homo sapiens
ggagagaaacccuauaaau

SEQ ID NO: 1586561 - RNA, 19 nt, Homo sapiens
ggagaaacccuacaagugu

SEQ ID NO: 1586562 - RNA, 19 nt, Homo sapiens
gagagaagcccuacaagug

SEQ ID NO: 1586563 - RNA, 19 nt, Homo sapiens
gggaaagccuucagugaug

SEQ ID NO: 1586564 - RNA, 19 nt, Homo sapiens
gaagagaagcccuacaaau

SEQ ID NO: 1586565 - RNA, 19 nt, Homo sapiens
gaucagagaccucacaaau

SEQ ID NO: 1586566 - RNA, 19 nt, Homo sapiens
agugauggcucaauccuua

SEQ ID NO: 1586567 - RNA, 19 nt, Homo sapiens
cuacaaaugugaugagugu

SEQ ID NO: 1586568 - RNA, 19 nt, Homo sapiens
aaucuucagugcaaacuua

SEQ ID NO: 1586569 - RNA, 19 nt, Homo sapiens
aaaggacguuucucauuaa

SEQ ID NO: 1586570 - RNA, 19 nt, Homo sapiens
ccacugugcugcugccuuu

SEQ ID NO: 1586571 - RNA, 19 nt, Homo sapiens
gagagaaacccuacagaug

SEQ ID NO: 1586572 - RNA, 19 nt, Homo sapiens
ccaaauaguugcaucacau

SEQ ID NO: 1586573 - RNA, 19 nt, Homo sapiens
gagaagcccuacaaaugug

SEQ ID NO: 1586574 - RNA, 19 nt, Homo sapiens
ggagacauuuggugaggaa

SEQ ID NO: 1586575 - RNA, 19 nt, Homo sapiens
guucuaaccuuauccaaca

SEQ ID NO: 1586576 - RNA, 19 nt, Homo sapiens
ccagggaucugagccagua

SEQ ID NO: 1586577 - RNA, 19 nt, Homo sapiens
gcaccugacucugcccuuu

SEQ ID NO: 1586578 - RNA, 19 nt, Homo sapiens
gggagaagcccuacaagug

SEQ ID NO: 1586579 - RNA, 19 nt, Homo sapiens
ggagagaagcccuaugaau

SEQ ID NO: 1586580 - RNA, 19 nt, Homo sapiens
ucugguagcuccucaguga

SEQ ID NO: 1586581 - RNA, 19 nt, Homo sapiens
aaaccaaacucguggaaca

SEQ ID NO: 1586582 - RNA, 19 nt, Homo sapiens
agagaaacccuauaaaugu

SEQ ID NO: 1586583 - RNA, 19 nt, Homo sapiens
agagaaacccuauaaaugu

SEQ ID NO: 1586584 - RNA, 19 nt, Homo sapiens
gaccagaacugaguacaag

SEQ ID NO: 1586585 - RNA, 19 nt, Homo sapiens
gagaaacccuacagaugca

SEQ ID NO: 1586586 - RNA, 19 nt, Homo sapiens
caaugacuguggcaaaguu

SEQ ID NO: 1586587 - RNA, 19 nt, Homo sapiens
caacaaccauaagcgugua

SEQ ID NO: 1586588 - RNA, 19 nt, Homo sapiens
aagagaagcccuacaaaug

SEQ ID NO: 1586589 - RNA, 19 nt, Homo sapiens
caagaccuguuccugauca

SEQ ID NO: 1586590 - RNA, 19 nt, Homo sapiens
ggagagaaacccuacagau

SEQ ID NO: 1586591 - RNA, 19 nt, Homo sapiens
ggagagaagccauuugagu

SEQ ID NO: 1586592 - RNA, 19 nt, Homo sapiens
gggagaaacccuacaagug

SEQ ID NO: 1586593 - RNA, 19 nt, Homo sapiens
gcugcgaguucaucaauca

SEQ ID NO: 1586594 - RNA, 19 nt, Homo sapiens
ggagagaagcccuacaagu

SEQ ID NO: 1586595 - RNA, 19 nt, Homo sapiens
acaaggaguugacuucaca

SEQ ID NO: 1586596 - RNA, 19 nt, Homo sapiens
ccagagcacguacuugauu

SEQ ID NO: 1586597 - RNA, 19 nt, Homo sapiens
gaagcccuaugaaugcaau

SEQ ID NO: 1586598 - RNA, 19 nt, Homo sapiens
gucaagaccuguuccugau

SEQ ID NO: 1586599 - RNA, 19 nt, Homo sapiens
cacaacaguuccagacuca

SEQ ID NO: 1586600 - RNA, 19 nt, Homo sapiens
caacaucagagaauucaca

SEQ ID NO: 1586601 - RNA, 19 nt, Homo sapiens
cgccuacucuucccugauu

SEQ ID NO: 1586602 - RNA, 19 nt, Homo sapiens
ggaccagaacugaguacaa

SEQ ID NO: 1586603 - RNA, 19 nt, Homo sapiens
acucugcccuuuauguauu

SEQ ID NO: 1586604 - RNA, 19 nt, Homo sapiens
ugacucugcccuuuaugua

SEQ ID NO: 1586605 - RNA, 19 nt, Homo sapiens
gguuugggaugcugacaug

SEQ ID NO: 1586606 - RNA, 19 nt, Homo sapiens
gagaagcccuaugaaugca

SEQ ID NO: 1586607 - RNA, 19 nt, Homo sapiens
ccaaacucguggaacauca

SEQ ID NO: 1586608 - RNA, 19 nt, Homo sapiens
acaaaguucuaaccuuauc

SEQ ID NO: 1586609 - RNA, 19 nt, Homo sapiens
agagaagcccuacaaaugu

SEQ ID NO: 1586610 - RNA, 19 nt, Homo sapiens
ugacuucacaggagacauu

SEQ ID NO: 1586611 - RNA, 19 nt, Homo sapiens
cggcacaguuccaacaugu

SEQ ID NO: 1586612 - RNA, 19 nt, Homo sapiens
uauccaacaucagagaauu

SEQ ID NO: 1586613 - RNA, 19 nt, Homo sapiens
ggcccaaccucaugaagca

SEQ ID NO: 1586614 - RNA, 19 nt, Homo sapiens
ugauauaugugagcaaagu

SEQ ID NO: 1586615 - RNA, 19 nt, Homo sapiens
gcccaacccucaggcaaug

SEQ ID NO: 1586616 - RNA, 19 nt, Homo sapiens
ccggagagaaacccuauaa

SEQ ID NO: 1586617 - RNA, 19 nt, Homo sapiens
gagcugcgaguucaucaau

SEQ ID NO: 1586618 - RNA, 19 nt, Homo sapiens
ucgaggacguggcugugua

SEQ ID NO: 1586619 - RNA, 19 nt, Homo sapiens
gcgggaaagccuucaguga

SEQ ID NO: 1586620 - RNA, 19 nt, Homo sapiens
ggggaaaucuucagugcaa

SEQ ID NO: 1586621 - RNA, 19 nt, Homo sapiens
ccaaagcacacaccucauc

SEQ ID NO: 1586622 - RNA, 19 nt, Homo sapiens
ugugauauaugugagcaaa

SEQ ID NO: 1586623 - RNA, 19 nt, Homo sapiens
cagagcacguacuugauuc

SEQ ID NO: 1586624 - RNA, 19 nt, Homo sapiens
auaguugcaucacauguau

SEQ ID NO: 1586625 - RNA, 19 nt, Homo sapiens
caacaguuccagacucauc

SEQ ID NO: 1586626 - RNA, 19 nt, Homo sapiens
caacaugugucagcaucag

SEQ ID NO: 1586627 - RNA, 19 nt, Homo sapiens
caggagagaagcccuacaa

SEQ ID NO: 1586628 - RNA, 19 nt, Homo sapiens
caaauaguugcaucacaug

SEQ ID NO: 1586629 - RNA, 19 nt, Homo sapiens
gccaaauaguugcaucaca

SEQ ID NO: 1586630 - RNA, 19 nt, Homo sapiens
uugcaucacauguaucuaa

SEQ ID NO: 1586631 - RNA, 19 nt, Homo sapiens
gaguccagcugagcacuuc

SEQ ID NO: 1586632 - RNA, 19 nt, Homo sapiens
gggcuuuccuuggcaaaca

SEQ ID NO: 1586633 - RNA, 19 nt, Homo sapiens
ccggagagaagccauuuga

SEQ ID NO: 1586634 - RNA, 19 nt, Homo sapiens
ggacucacaccggagagaa

SEQ ID NO: 1586635 - RNA, 19 nt, Homo sapiens
gacauuuggugaggaagau

SEQ ID NO: 1586636 - RNA, 19 nt, Homo sapiens
caccugacucugcccuuua

SEQ ID NO: 1586637 - RNA, 19 nt, Homo sapiens
gaauucacacuggagagaa

SEQ ID NO: 1586638 - RNA, 19 nt, Homo sapiens
gugcaaggaauguggcaaa

SEQ ID NO: 1586639 - RNA, 19 nt, Homo sapiens
aauaguugcaucacaugua

SEQ ID NO: 1586640 - RNA, 19 nt, Homo sapiens
gaugcacucaggagagauu

SEQ ID NO: 1586641 - RNA, 19 nt, Homo sapiens
ugaagagaagcccuacaaa

SEQ ID NO: 1586642 - RNA, 19 nt, Homo sapiens
ucauaucucaacaaccaua

SEQ ID NO: 1586643 - RNA, 19 nt, Homo sapiens
cuggagagaaacccuauaa

SEQ ID NO: 1586644 - RNA, 19 nt, Homo sapiens
uacacaaaguucuaaccuu

SEQ ID NO: 1586645 - RNA, 19 nt, Homo sapiens
ccauuugagugcaaggaau

SEQ ID NO: 1586646 - RNA, 19 nt, Homo sapiens
caucacauguaucuaaucc

SEQ ID NO: 1586647 - RNA, 19 nt, Homo sapiens
guacaaggaguugacuuca

SEQ ID NO: 1586648 - RNA, 19 nt, Homo sapiens
guacagugccaaccuuguc

SEQ ID NO: 1586649 - RNA, 19 nt, Homo sapiens
gggaaaucuucagugcaaa

SEQ ID NO: 1586650 - RNA, 19 nt, Homo sapiens
aaggacguuucucauuaaa

SEQ ID NO: 1586651 - RNA, 19 nt, Homo sapiens
gcacgcaucuucuccuuug

SEQ ID NO: 1586652 - RNA, 19 nt, Homo sapiens
gcaacaagguccucuguca

SEQ ID NO: 1586653 - RNA, 19 nt, Homo sapiens
ccucagagcugcuggaaga

SEQ ID NO: 1586654 - RNA, 19 nt, Homo sapiens
gggcuggccucccaaauga

SEQ ID NO: 1586655 - RNA, 19 nt, Homo sapiens
ggaaggcgaugacucagau

SEQ ID NO: 1586656 - RNA, 19 nt, Homo sapiens
gagcggacccugacaaguu

SEQ ID NO: 1586657 - RNA, 19 nt, Homo sapiens
caaaugagccaugagauga

SEQ ID NO: 1586658 - RNA, 19 nt, Homo sapiens
guaauugugugugauguga

SEQ ID NO: 1586659 - RNA, 19 nt, Homo sapiens
gcucagaggcgcacuguga

SEQ ID NO: 1586660 - RNA, 19 nt, Homo sapiens
gaacacggccacaucaaag

SEQ ID NO: 1586661 - RNA, 19 nt, Homo sapiens
ggaacacggccacaucaaa

SEQ ID NO: 1586662 - RNA, 19 nt, Homo sapiens
gaagccugaugcugacauu

SEQ ID NO: 1586663 - RNA, 19 nt, Homo sapiens
gcaguuuccguuugacuuu

SEQ ID NO: 1586664 - RNA, 19 nt, Homo sapiens
guuaggagcucagacacuu

SEQ ID NO: 1586665 - RNA, 19 nt, Homo sapiens
gggagaaguuggagcagau

SEQ ID NO: 1586666 - RNA, 19 nt, Homo sapiens
gcucagcucugggccauuc

SEQ ID NO: 1586667 - RNA, 19 nt, Homo sapiens
gaagccaaagaguguauuu

SEQ ID NO: 1586668 - RNA, 19 nt, Homo sapiens
aagcugaccuucauugaca

SEQ ID NO: 1586669 - RNA, 19 nt, Homo sapiens
gaagggagaccgaggugau

SEQ ID NO: 1586670 - RNA, 19 nt, Homo sapiens
gugaggaguuccagagaau

SEQ ID NO: 1586671 - RNA, 19 nt, Homo sapiens
gaaccgggcagcaucuuca

SEQ ID NO: 1586672 - RNA, 19 nt, Homo sapiens
gagccgagauccugaacgu

SEQ ID NO: 1586673 - RNA, 19 nt, Homo sapiens
ucaagggacccaugaguug

SEQ ID NO: 1586674 - RNA, 19 nt, Homo sapiens
ccaaaugagccaugagaug

SEQ ID NO: 1586675 - RNA, 19 nt, Homo sapiens
cauguaauccucaagaaau

SEQ ID NO: 1586676 - RNA, 19 nt, Homo sapiens
ggcuuugguucaauaauga

SEQ ID NO: 1586677 - RNA, 19 nt, Homo sapiens
caagggagagauuggcuuu

SEQ ID NO: 1586678 - RNA, 19 nt, Homo sapiens
guucuguaauuguguguga

SEQ ID NO: 1586679 - RNA, 19 nt, Homo sapiens
aaaggaagccaaagagugu

SEQ ID NO: 1586680 - RNA, 19 nt, Homo sapiens
uaguucacguuucauguaa

SEQ ID NO: 1586681 - RNA, 19 nt, Homo sapiens
guuggaggcugaaaugaag

SEQ ID NO: 1586682 - RNA, 19 nt, Homo sapiens
gaagauuccagaagugaag

SEQ ID NO: 1586683 - RNA, 19 nt, Homo sapiens
ggugaucgcugagcugaag

SEQ ID NO: 1586684 - RNA, 19 nt, Homo sapiens
aaugagccaugagaugaua

SEQ ID NO: 1586685 - RNA, 19 nt, Homo sapiens
gaccacggcucgauuucuc

SEQ ID NO: 1586686 - RNA, 19 nt, Homo sapiens
gaaauaaaaggaagccaaa

SEQ ID NO: 1586687 - RNA, 19 nt, Homo sapiens
cagggcaguuuccguuuga

SEQ ID NO: 1586688 - RNA, 19 nt, Homo sapiens
ccagggcaguuuccguuug

SEQ ID NO: 1586689 - RNA, 19 nt, Homo sapiens
caauucagacaggcaaaua

SEQ ID NO: 1586690 - RNA, 19 nt, Homo sapiens
cgaggaaggcgaugacuca

SEQ ID NO: 1586691 - RNA, 19 nt, Homo sapiens
ggacaucucccugcucuac

SEQ ID NO: 1586692 - RNA, 19 nt, Homo sapiens
gaaguuggagcagauggaa

SEQ ID NO: 1586693 - RNA, 19 nt, Homo sapiens
uggcuuugguucaauaaug

SEQ ID NO: 1586694 - RNA, 19 nt, Homo sapiens
ccucaggacugcgacgaaa

SEQ ID NO: 1586695 - RNA, 19 nt, Homo sapiens
gggcacgcaucuucuccuu

SEQ ID NO: 1586696 - RNA, 19 nt, Homo sapiens
ggagaugccagccuuggau

SEQ ID NO: 1586697 - RNA, 19 nt, Homo sapiens
gacaagcugaccuucauug

SEQ ID NO: 1586698 - RNA, 19 nt, Homo sapiens
gggaugaacggauugaaag

SEQ ID NO: 1586699 - RNA, 19 nt, Homo sapiens
ccaaaggcauccggagcuu

SEQ ID NO: 1586700 - RNA, 19 nt, Homo sapiens
agggagggcugucaucugu

SEQ ID NO: 1586701 - RNA, 19 nt, Homo sapiens
ugaagcagguucccaagcu

SEQ ID NO: 1586702 - RNA, 19 nt, Homo sapiens
caggcagggugcaguauca

SEQ ID NO: 1586703 - RNA, 19 nt, Homo sapiens
ggucaggcagggugcagua

SEQ ID NO: 1586704 - RNA, 19 nt, Homo sapiens
guucacguuucauguaauc

SEQ ID NO: 1586705 - RNA, 19 nt, Homo sapiens
ugaccgagagcuacuguga

SEQ ID NO: 1586706 - RNA, 19 nt, Homo sapiens
uggauuugaugacauggaa

SEQ ID NO: 1586707 - RNA, 19 nt, Homo sapiens
ccaaccugcugaaccugaa

SEQ ID NO: 1586708 - RNA, 19 nt, Homo sapiens
cagcagauaccaccacaca

SEQ ID NO: 1586709 - RNA, 19 nt, Homo sapiens
caaggacgagcugcuguuu

SEQ ID NO: 1586710 - RNA, 19 nt, Homo sapiens
cacgagggacggacaauga

SEQ ID NO: 1586711 - RNA, 19 nt, Homo sapiens
aggaaggacugggcagaaa

SEQ ID NO: 1586712 - RNA, 19 nt, Homo sapiens
ucagaccacggcucgauuu

SEQ ID NO: 1586713 - RNA, 19 nt, Homo sapiens
accgagagcuacugugaga

SEQ ID NO: 1586714 - RNA, 19 nt, Homo sapiens
gaugccagccuuggauuug

SEQ ID NO: 1586715 - RNA, 19 nt, Homo sapiens
cucgauuucuccaggauuu

SEQ ID NO: 1586716 - RNA, 19 nt, Homo sapiens
gaucagaccacggcucgau

SEQ ID NO: 1586717 - RNA, 19 nt, Homo sapiens
gaugaacggauugaaagga

SEQ ID NO: 1586718 - RNA, 19 nt, Homo sapiens
ugugaggaguuccagagaa

SEQ ID NO: 1586719 - RNA, 19 nt, Homo sapiens
acaaaacccagaccuguua

SEQ ID NO: 1586720 - RNA, 19 nt, Homo sapiens
cuguauaguucacguuuca

SEQ ID NO: 1586721 - RNA, 19 nt, Homo sapiens
gggcuggccuacgucuuug

SEQ ID NO: 1586722 - RNA, 19 nt, Homo sapiens
gagaugccagccuuggauu

SEQ ID NO: 1586723 - RNA, 19 nt, Homo sapiens
gggccauucuccacagcaa

SEQ ID NO: 1586724 - RNA, 19 nt, Homo sapiens
gcucugaggguccgcugaa

SEQ ID NO: 1586725 - RNA, 19 nt, Homo sapiens
gugcagcccacagcagaua

SEQ ID NO: 1586726 - RNA, 19 nt, Homo sapiens
ucauguaauccucaagaaa

SEQ ID NO: 1586727 - RNA, 19 nt, Homo sapiens
ucaugacugccuccaagua

SEQ ID NO: 1586728 - RNA, 19 nt, Homo sapiens
ggaaggacugggcagaaag

SEQ ID NO: 1586729 - RNA, 19 nt, Homo sapiens
cacgguggcuucguuagga

SEQ ID NO: 1586730 - RNA, 19 nt, Homo sapiens
gggccaaccugcugaaccu

SEQ ID NO: 1586731 - RNA, 19 nt, Homo sapiens
aguccaagcugggagauuc

SEQ ID NO: 1586732 - RNA, 19 nt, Homo sapiens
gggccgacuuccagugcuu

SEQ ID NO: 1586733 - RNA, 19 nt, Homo sapiens
ccucacaggcagacuauca

SEQ ID NO: 1586734 - RNA, 19 nt, Homo sapiens
guuugacuuucuucaguug

SEQ ID NO: 1586735 - RNA, 19 nt, Homo sapiens
uuacgacagcaauguguuu

SEQ ID NO: 1586736 - RNA, 19 nt, Homo sapiens
gaaggacugggcagaaagg

SEQ ID NO: 1586737 - RNA, 19 nt, Homo sapiens
gcagcagcacggaagauuc

SEQ ID NO: 1586738 - RNA, 19 nt, Homo sapiens
ccugagauccggcaacauc

SEQ ID NO: 1586739 - RNA, 19 nt, Homo sapiens
auaguucacguuucaugua

SEQ ID NO: 1586740 - RNA, 19 nt, Homo sapiens
guauaguucacguuucaug

SEQ ID NO: 1586741 - RNA, 19 nt, Homo sapiens
cguuugacuuucuucaguu

SEQ ID NO: 1586742 - RNA, 19 nt, Homo sapiens
aaccugaacuggcuuuggu

SEQ ID NO: 1586743 - RNA, 19 nt, Homo sapiens
acgacaagcugaccuucau

SEQ ID NO: 1586744 - RNA, 19 nt, Homo sapiens
gacacuuccuggcucagau

SEQ ID NO: 1586745 - RNA, 19 nt, Homo sapiens
gcacugccuggacgaggaa

SEQ ID NO: 1586746 - RNA, 19 nt, Homo sapiens
ugugugaugugaagccaau

SEQ ID NO: 1586747 - RNA, 19 nt, Homo sapiens
ggaaacccauauccuuacc

SEQ ID NO: 1586748 - RNA, 19 nt, Homo sapiens
cauuggcugucuccuagga

SEQ ID NO: 1586749 - RNA, 19 nt, Homo sapiens
cuacaucgugcucugcauu

SEQ ID NO: 1586750 - RNA, 19 nt, Homo sapiens
gcaggcugaccgagagcua

SEQ ID NO: 1586751 - RNA, 19 nt, Homo sapiens
gcacgcaucuucuccuuug

SEQ ID NO: 1586752 - RNA, 19 nt, Homo sapiens
gcaacaagguccucuguca

SEQ ID NO: 1586753 - RNA, 19 nt, Homo sapiens
ccucagagcugcuggaaga

SEQ ID NO: 1586754 - RNA, 19 nt, Homo sapiens
gggcuggccucccaaauga

SEQ ID NO: 1586755 - RNA, 19 nt, Homo sapiens
ggaaggcgaugacucagau

SEQ ID NO: 1586756 - RNA, 19 nt, Homo sapiens
gagcggacccugacaaguu

SEQ ID NO: 1586757 - RNA, 19 nt, Homo sapiens
caaaugagccaugagauga

SEQ ID NO: 1586758 - RNA, 19 nt, Homo sapiens
guaauugugugugauguga

SEQ ID NO: 1586759 - RNA, 19 nt, Homo sapiens
gcucagaggcgcacuguga

SEQ ID NO: 1586760 - RNA, 19 nt, Homo sapiens
gaacacggccacaucaaag

SEQ ID NO: 1586761 - RNA, 19 nt, Homo sapiens
ggaacacggccacaucaaa

SEQ ID NO: 1586762 - RNA, 19 nt, Homo sapiens
gaagccugaugcugacauu

SEQ ID NO: 1586763 - RNA, 19 nt, Homo sapiens
gcaguuuccguuugacuuu

SEQ ID NO: 1586764 - RNA, 19 nt, Homo sapiens
guuaggagcucagacacuu

SEQ ID NO: 1586765 - RNA, 19 nt, Homo sapiens
gggagaaguuggagcagau

SEQ ID NO: 1586766 - RNA, 19 nt, Homo sapiens
gcucagcucugggccauuc

SEQ ID NO: 1586767 - RNA, 19 nt, Homo sapiens
gaagccaaagaguguauuu

SEQ ID NO: 1586768 - RNA, 19 nt, Homo sapiens
aagcugaccuucauugaca

SEQ ID NO: 1586769 - RNA, 19 nt, Homo sapiens
gaagggagaccgaggugau

SEQ ID NO: 1586770 - RNA, 19 nt, Homo sapiens
gugaggaguuccagagaau

SEQ ID NO: 1586771 - RNA, 19 nt, Homo sapiens
gaaccgggcagcaucuuca

SEQ ID NO: 1586772 - RNA, 19 nt, Homo sapiens
gagccgagauccugaacgu

SEQ ID NO: 1586773 - RNA, 19 nt, Homo sapiens
ucaagggacccaugaguug

SEQ ID NO: 1586774 - RNA, 19 nt, Homo sapiens
ccaaaugagccaugagaug

SEQ ID NO: 1586775 - RNA, 19 nt, Homo sapiens
cauguaauccucaagaaau

SEQ ID NO: 1586776 - RNA, 19 nt, Homo sapiens
ggcuuugguucaauaauga

SEQ ID NO: 1586777 - RNA, 19 nt, Homo sapiens
caagggagagauuggcuuu

SEQ ID NO: 1586778 - RNA, 19 nt, Homo sapiens
guucuguaauuguguguga

SEQ ID NO: 1586779 - RNA, 19 nt, Homo sapiens
aaaggaagccaaagagugu

SEQ ID NO: 1586780 - RNA, 19 nt, Homo sapiens
uaguucacguuucauguaa

SEQ ID NO: 1586781 - RNA, 19 nt, Homo sapiens
guuggaggcugaaaugaag

SEQ ID NO: 1586782 - RNA, 19 nt, Homo sapiens
gaagauuccagaagugaag

SEQ ID NO: 1586783 - RNA, 19 nt, Homo sapiens
ggugaucgcugagcugaag

SEQ ID NO: 1586784 - RNA, 19 nt, Homo sapiens
aaugagccaugagaugaua

SEQ ID NO: 1586785 - RNA, 19 nt, Homo sapiens
gaccacggcucgauuucuc

SEQ ID NO: 1586786 - RNA, 19 nt, Homo sapiens
gaaauaaaaggaagccaaa

SEQ ID NO: 1586787 - RNA, 19 nt, Homo sapiens
cagggcaguuuccguuuga

SEQ ID NO: 1586788 - RNA, 19 nt, Homo sapiens
ccagggcaguuuccguuug

SEQ ID NO: 1586789 - RNA, 19 nt, Homo sapiens
caauucagacaggcaaaua

SEQ ID NO: 1586790 - RNA, 19 nt, Homo sapiens
cgaggaaggcgaugacuca

SEQ ID NO: 1586791 - RNA, 19 nt, Homo sapiens
ggacaucucccugcucuac

SEQ ID NO: 1586792 - RNA, 19 nt, Homo sapiens
gaaguuggagcagauggaa

SEQ ID NO: 1586793 - RNA, 19 nt, Homo sapiens
uggcuuugguucaauaaug

SEQ ID NO: 1586794 - RNA, 19 nt, Homo sapiens
ccucaggacugcgacgaaa

SEQ ID NO: 1586795 - RNA, 19 nt, Homo sapiens
gggcacgcaucuucuccuu

SEQ ID NO: 1586796 - RNA, 19 nt, Homo sapiens
ggagaugccagccuuggau

SEQ ID NO: 1586797 - RNA, 19 nt, Homo sapiens
gacaagcugaccuucauug

SEQ ID NO: 1586798 - RNA, 19 nt, Homo sapiens
gggaugaacggauugaaag

SEQ ID NO: 1586799 - RNA, 19 nt, Homo sapiens
ccaaaggcauccggagcuu

SEQ ID NO: 1586800 - RNA, 19 nt, Homo sapiens
agggagggcugucaucugu

SEQ ID NO: 1586801 - RNA, 19 nt, Homo sapiens
ugaagcagguucccaagcu

SEQ ID NO: 1586802 - RNA, 19 nt, Homo sapiens
caggcagggugcaguauca

SEQ ID NO: 1586803 - RNA, 19 nt, Homo sapiens
ggucaggcagggugcagua

SEQ ID NO: 1586804 - RNA, 19 nt, Homo sapiens
guucacguuucauguaauc

SEQ ID NO: 1586805 - RNA, 19 nt, Homo sapiens
ugaccgagagcuacuguga

SEQ ID NO: 1586806 - RNA, 19 nt, Homo sapiens
uggauuugaugacauggaa

SEQ ID NO: 1586807 - RNA, 19 nt, Homo sapiens
ccaaccugcugaaccugaa

SEQ ID NO: 1586808 - RNA, 19 nt, Homo sapiens
cagcagauaccaccacaca

SEQ ID NO: 1586809 - RNA, 19 nt, Homo sapiens
caaggacgagcugcuguuu

SEQ ID NO: 1586810 - RNA, 19 nt, Homo sapiens
cacgagggacggacaauga

SEQ ID NO: 1586811 - RNA, 19 nt, Homo sapiens
aggaaggacugggcagaaa

SEQ ID NO: 1586812 - RNA, 19 nt, Homo sapiens
ucagaccacggcucgauuu

SEQ ID NO: 1586813 - RNA, 19 nt, Homo sapiens
accgagagcuacugugaga

SEQ ID NO: 1586814 - RNA, 19 nt, Homo sapiens
gaugccagccuuggauuug

SEQ ID NO: 1586815 - RNA, 19 nt, Homo sapiens
cucgauuucuccaggauuu

SEQ ID NO: 1586816 - RNA, 19 nt, Homo sapiens
gaucagaccacggcucgau

SEQ ID NO: 1586817 - RNA, 19 nt, Homo sapiens
gaugaacggauugaaagga

SEQ ID NO: 1586818 - RNA, 19 nt, Homo sapiens
ugugaggaguuccagagaa

SEQ ID NO: 1586819 - RNA, 19 nt, Homo sapiens
acaaaacccagaccuguua

SEQ ID NO: 1586820 - RNA, 19 nt, Homo sapiens
cuguauaguucacguuuca

SEQ ID NO: 1586821 - RNA, 19 nt, Homo sapiens
gggcuggccuacgucuuug

SEQ ID NO: 1586822 - RNA, 19 nt, Homo sapiens
gagaugccagccuuggauu

SEQ ID NO: 1586823 - RNA, 19 nt, Homo sapiens
gggccauucuccacagcaa

SEQ ID NO: 1586824 - RNA, 19 nt, Homo sapiens
gcucugaggguccgcugaa

SEQ ID NO: 1586825 - RNA, 19 nt, Homo sapiens
gugcagcccacagcagaua

SEQ ID NO: 1586826 - RNA, 19 nt, Homo sapiens
ucauguaauccucaagaaa

SEQ ID NO: 1586827 - RNA, 19 nt, Homo sapiens
ucaugacugccuccaagua

SEQ ID NO: 1586828 - RNA, 19 nt, Homo sapiens
ggaaggacugggcagaaag

SEQ ID NO: 1586829 - RNA, 19 nt, Homo sapiens
cacgguggcuucguuagga

SEQ ID NO: 1586830 - RNA, 19 nt, Homo sapiens
gggccaaccugcugaaccu

SEQ ID NO: 1586831 - RNA, 19 nt, Homo sapiens
aguccaagcugggagauuc

SEQ ID NO: 1586832 - RNA, 19 nt, Homo sapiens
gggccgacuuccagugcuu

SEQ ID NO: 1586833 - RNA, 19 nt, Homo sapiens
ccucacaggcagacuauca

SEQ ID NO: 1586834 - RNA, 19 nt, Homo sapiens
guuugacuuucuucaguug

SEQ ID NO: 1586835 - RNA, 19 nt, Homo sapiens
uuacgacagcaauguguuu

SEQ ID NO: 1586836 - RNA, 19 nt, Homo sapiens
gaaggacugggcagaaagg

SEQ ID NO: 1586837 - RNA, 19 nt, Homo sapiens
gcagcagcacggaagauuc

SEQ ID NO: 1586838 - RNA, 19 nt, Homo sapiens
ccugagauccggcaacauc

SEQ ID NO: 1586839 - RNA, 19 nt, Homo sapiens
auaguucacguuucaugua

SEQ ID NO: 1586840 - RNA, 19 nt, Homo sapiens
guauaguucacguuucaug

SEQ ID NO: 1586841 - RNA, 19 nt, Homo sapiens
cguuugacuuucuucaguu

SEQ ID NO: 1586842 - RNA, 19 nt, Homo sapiens
aaccugaacuggcuuuggu

SEQ ID NO: 1586843 - RNA, 19 nt, Homo sapiens
acgacaagcugaccuucau

SEQ ID NO: 1586844 - RNA, 19 nt, Homo sapiens
gacacuuccuggcucagau

SEQ ID NO: 1586845 - RNA, 19 nt, Homo sapiens
gcacugccuggacgaggaa

SEQ ID NO: 1586846 - RNA, 19 nt, Homo sapiens
ugugugaugugaagccaau

SEQ ID NO: 1586847 - RNA, 19 nt, Homo sapiens
ggaaacccauauccuuacc

SEQ ID NO: 1586848 - RNA, 19 nt, Homo sapiens
cauuggcugucuccuagga

SEQ ID NO: 1586849 - RNA, 19 nt, Homo sapiens
cuacaucgugcucugcauu

SEQ ID NO: 1586850 - RNA, 19 nt, Homo sapiens
gcaggcugaccgagagcua

SEQ ID NO: 1586851 - RNA, 19 nt, Homo sapiens
gcacgcaucuucuccuuug

SEQ ID NO: 1586852 - RNA, 19 nt, Homo sapiens
gcaacaagguccucuguca

SEQ ID NO: 1586853 - RNA, 19 nt, Homo sapiens
gggcuggccucccaaauga

SEQ ID NO: 1586854 - RNA, 19 nt, Homo sapiens
ggaaggcgaugacucagau

SEQ ID NO: 1586855 - RNA, 19 nt, Homo sapiens
gagcggacccugacaaguu

SEQ ID NO: 1586856 - RNA, 19 nt, Homo sapiens
caaaugagccaugagauga

SEQ ID NO: 1586857 - RNA, 19 nt, Homo sapiens
guaauugugugugauguga

SEQ ID NO: 1586858 - RNA, 19 nt, Homo sapiens
gcucagaggcgcacuguga

SEQ ID NO: 1586859 - RNA, 19 nt, Homo sapiens
gaacacggccacaucaaag

SEQ ID NO: 1586860 - RNA, 19 nt, Homo sapiens
ggaacacggccacaucaaa

SEQ ID NO: 1586861 - RNA, 19 nt, Homo sapiens
gaagccugaugcugacauu

SEQ ID NO: 1586862 - RNA, 19 nt, Homo sapiens
gcaguuuccguuugacuuu

SEQ ID NO: 1586863 - RNA, 19 nt, Homo sapiens
guuaggagcucagacacuu

SEQ ID NO: 1586864 - RNA, 19 nt, Homo sapiens
gggagaaguuggagcagau

SEQ ID NO: 1586865 - RNA, 19 nt, Homo sapiens
gcucagcucugggccauuc

SEQ ID NO: 1586866 - RNA, 19 nt, Homo sapiens
gaagccaaagaguguauuu

SEQ ID NO: 1586867 - RNA, 19 nt, Homo sapiens
aagcugaccuucauugaca

SEQ ID NO: 1586868 - RNA, 19 nt, Homo sapiens
gaagggagaccgaggugau

SEQ ID NO: 1586869 - RNA, 19 nt, Homo sapiens
gugaggaguuccagagaau

SEQ ID NO: 1586870 - RNA, 19 nt, Homo sapiens
gaaccgggcagcaucuuca

SEQ ID NO: 1586871 - RNA, 19 nt, Homo sapiens
ucaagggacccaugaguug

SEQ ID NO: 1586872 - RNA, 19 nt, Homo sapiens
ccaaaugagccaugagaug

SEQ ID NO: 1586873 - RNA, 19 nt, Homo sapiens
cauguaauccucaagaaau

SEQ ID NO: 1586874 - RNA, 19 nt, Homo sapiens
caagggagagauuggcuuu

SEQ ID NO: 1586875 - RNA, 19 nt, Homo sapiens
guucuguaauuguguguga

SEQ ID NO: 1586876 - RNA, 19 nt, Homo sapiens
aaaggaagccaaagagugu

SEQ ID NO: 1586877 - RNA, 19 nt, Homo sapiens
uaguucacguuucauguaa

SEQ ID NO: 1586878 - RNA, 19 nt, Homo sapiens
guuggaggcugaaaugaag

SEQ ID NO: 1586879 - RNA, 19 nt, Homo sapiens
gaagauuccagaagugaag

SEQ ID NO: 1586880 - RNA, 19 nt, Homo sapiens
ggugaucgcugagcugaag

SEQ ID NO: 1586881 - RNA, 19 nt, Homo sapiens
aaugagccaugagaugaua

SEQ ID NO: 1586882 - RNA, 19 nt, Homo sapiens
gaccacggcucgauuucuc

SEQ ID NO: 1586883 - RNA, 19 nt, Homo sapiens
gaaauaaaaggaagccaaa

SEQ ID NO: 1586884 - RNA, 19 nt, Homo sapiens
cagggcaguuuccguuuga

SEQ ID NO: 1586885 - RNA, 19 nt, Homo sapiens
ccagggcaguuuccguuug

SEQ ID NO: 1586886 - RNA, 19 nt, Homo sapiens
caauucagacaggcaaaua

SEQ ID NO: 1586887 - RNA, 19 nt, Homo sapiens
cgaggaaggcgaugacuca

SEQ ID NO: 1586888 - RNA, 19 nt, Homo sapiens
ggacaucucccugcucuac

SEQ ID NO: 1586889 - RNA, 19 nt, Homo sapiens
gaaguuggagcagauggaa

SEQ ID NO: 1586890 - RNA, 19 nt, Homo sapiens
ccucaggacugcgacgaaa

SEQ ID NO: 1586891 - RNA, 19 nt, Homo sapiens
gggcacgcaucuucuccuu

SEQ ID NO: 1586892 - RNA, 19 nt, Homo sapiens
ggagaugccagccuuggau

SEQ ID NO: 1586893 - RNA, 19 nt, Homo sapiens
gacaagcugaccuucauug

SEQ ID NO: 1586894 - RNA, 19 nt, Homo sapiens
gggaugaacggauugaaag

SEQ ID NO: 1586895 - RNA, 19 nt, Homo sapiens
agggagggcugucaucugu

SEQ ID NO: 1586896 - RNA, 19 nt, Homo sapiens
ugaagcagguucccaagcu

SEQ ID NO: 1586897 - RNA, 19 nt, Homo sapiens
caggcagggugcaguauca

SEQ ID NO: 1586898 - RNA, 19 nt, Homo sapiens
ggucaggcagggugcagua

SEQ ID NO: 1586899 - RNA, 19 nt, Homo sapiens
guucacguuucauguaauc

SEQ ID NO: 1586900 - RNA, 19 nt, Homo sapiens
ugaccgagagcuacuguga

SEQ ID NO: 1586901 - RNA, 19 nt, Homo sapiens
uggauuugaugacauggaa

SEQ ID NO: 1586902 - RNA, 19 nt, Homo sapiens
caaggacgagcugcuguuu

SEQ ID NO: 1586903 - RNA, 19 nt, Homo sapiens
cacgagggacggacaauga

SEQ ID NO: 1586904 - RNA, 19 nt, Homo sapiens
aggaaggacugggcagaaa

SEQ ID NO: 1586905 - RNA, 19 nt, Homo sapiens
ucagaccacggcucgauuu

SEQ ID NO: 1586906 - RNA, 19 nt, Homo sapiens
accgagagcuacugugaga

SEQ ID NO: 1586907 - RNA, 19 nt, Homo sapiens
gaugccagccuuggauuug

SEQ ID NO: 1586908 - RNA, 19 nt, Homo sapiens
cucgauuucuccaggauuu

SEQ ID NO: 1586909 - RNA, 19 nt, Homo sapiens
gaucagaccacggcucgau

SEQ ID NO: 1586910 - RNA, 19 nt, Homo sapiens
gaugaacggauugaaagga

SEQ ID NO: 1586911 - RNA, 19 nt, Homo sapiens
ugugaggaguuccagagaa

SEQ ID NO: 1586912 - RNA, 19 nt, Homo sapiens
acaaaacccagaccuguua

SEQ ID NO: 1586913 - RNA, 19 nt, Homo sapiens
cuguauaguucacguuuca

SEQ ID NO: 1586914 - RNA, 19 nt, Homo sapiens
gagaugccagccuuggauu

SEQ ID NO: 1586915 - RNA, 19 nt, Homo sapiens
gggcuggccuacgucuuug

SEQ ID NO: 1586916 - RNA, 19 nt, Homo sapiens
gggccauucuccacagcaa

SEQ ID NO: 1586917 - RNA, 19 nt, Homo sapiens
gcucugaggguccgcugaa

SEQ ID NO: 1586918 - RNA, 19 nt, Homo sapiens
ucauguaauccucaagaaa

SEQ ID NO: 1586919 - RNA, 19 nt, Homo sapiens
ucaugacugccuccaagua

SEQ ID NO: 1586920 - RNA, 19 nt, Homo sapiens
ggaaggacugggcagaaag

SEQ ID NO: 1586921 - RNA, 19 nt, Homo sapiens
cacgguggcuucguuagga

SEQ ID NO: 1586922 - RNA, 19 nt, Homo sapiens
aguccaagcugggagauuc

SEQ ID NO: 1586923 - RNA, 19 nt, Homo sapiens
gggccgacuuccagugcuu

SEQ ID NO: 1586924 - RNA, 19 nt, Homo sapiens
ccucacaggcagacuauca

SEQ ID NO: 1586925 - RNA, 19 nt, Homo sapiens
guuugacuuucuucaguug

SEQ ID NO: 1586926 - RNA, 19 nt, Homo sapiens
uuacgacagcaauguguuu

SEQ ID NO: 1586927 - RNA, 19 nt, Homo sapiens
gaaggacugggcagaaagg

SEQ ID NO: 1586928 - RNA, 19 nt, Homo sapiens
gcagcagcacggaagauuc

SEQ ID NO: 1586929 - RNA, 19 nt, Homo sapiens
ccugagauccggcaacauc

SEQ ID NO: 1586930 - RNA, 19 nt, Homo sapiens
gcacugccuggacgaggaa

SEQ ID NO: 1586931 - RNA, 19 nt, Homo sapiens
auaguucacguuucaugua

SEQ ID NO: 1586932 - RNA, 19 nt, Homo sapiens
guauaguucacguuucaug

SEQ ID NO: 1586933 - RNA, 19 nt, Homo sapiens
cguuugacuuucuucaguu

SEQ ID NO: 1586934 - RNA, 19 nt, Homo sapiens
acgacaagcugaccuucau

SEQ ID NO: 1586935 - RNA, 19 nt, Homo sapiens
gacacuuccuggcucagau

SEQ ID NO: 1586936 - RNA, 19 nt, Homo sapiens
ugugugaugugaagccaau

SEQ ID NO: 1586937 - RNA, 19 nt, Homo sapiens
ggaaacccauauccuuacc

SEQ ID NO: 1586938 - RNA, 19 nt, Homo sapiens
cauuggcugucuccuagga

SEQ ID NO: 1586939 - RNA, 19 nt, Homo sapiens
cuacaucgugcucugcauu

SEQ ID NO: 1586940 - RNA, 19 nt, Homo sapiens
gcaggcugaccgagagcua

SEQ ID NO: 1586941 - RNA, 19 nt, Homo sapiens
cgggaugaacggauugaaa

SEQ ID NO: 1586942 - RNA, 19 nt, Homo sapiens
cuucuuccgugacuucuca

SEQ ID NO: 1586943 - RNA, 19 nt, Homo sapiens
cgggcuggccuacgucuuu

SEQ ID NO: 1586944 - RNA, 19 nt, Homo sapiens
ugacuucaucucccaccua

SEQ ID NO: 1586945 - RNA, 19 nt, Homo sapiens
ggagggacaaguggacuca

SEQ ID NO: 1586946 - RNA, 19 nt, Homo sapiens
caagguccucugucaguca

SEQ ID NO: 1586947 - RNA, 19 nt, Homo sapiens
uuccagaagugaagaaguc

SEQ ID NO: 1586948 - RNA, 19 nt, Homo sapiens
ccguuugacuuucuucagu

SEQ ID NO: 1586949 - RNA, 19 nt, Homo sapiens
ugaccuucauugacaugga

SEQ ID NO: 1586950 - RNA, 19 nt, Homo sapiens
cgacaagcugaccuucauu

SEQ ID NO: 1586951 - RNA, 19 nt, Homo sapiens
ggagagcgaugcuaaguuu

SEQ ID NO: 1586952 - RNA, 19 nt, Homo sapiens
gacaacaucuggaucagua

SEQ ID NO: 1586953 - RNA, 19 nt, Homo sapiens
gagcuuagauuaccuagau

SEQ ID NO: 1586954 - RNA, 19 nt, Homo sapiens
gcacagacccuacaggaaa

SEQ ID NO: 1586955 - RNA, 19 nt, Homo sapiens
cauggaagcugaggacuua

SEQ ID NO: 1586956 - RNA, 19 nt, Homo sapiens
ucacaccacuggguaaaua

SEQ ID NO: 1586957 - RNA, 19 nt, Homo sapiens
gaaaaggacuggagcaaga

SEQ ID NO: 1586958 - RNA, 19 nt, Homo sapiens
gaggauggaugguaucaau

SEQ ID NO: 1586959 - RNA, 19 nt, Homo sapiens
cuacaguguucauaguuua

SEQ ID NO: 1586960 - RNA, 19 nt, Homo sapiens
gaagggagcuggguaugca

SEQ ID NO: 1586961 - RNA, 19 nt, Homo sapiens
gacaggaaauccaaucaga

SEQ ID NO: 1586962 - RNA, 19 nt, Homo sapiens
ccaaucagaugaccuuugu

SEQ ID NO: 1586963 - RNA, 19 nt, Homo sapiens
gcucacauuucaacuuuau

SEQ ID NO: 1586964 - RNA, 19 nt, Homo sapiens
gcgcagcacucucccaguu

SEQ ID NO: 1586965 - RNA, 19 nt, Homo sapiens
gcuacaguguucauaguuu

SEQ ID NO: 1586966 - RNA, 19 nt, Homo sapiens
gcagcaggguuagcauuaa

SEQ ID NO: 1586967 - RNA, 19 nt, Homo sapiens
gugcucacauuucaacuuu

SEQ ID NO: 1586968 - RNA, 19 nt, Homo sapiens
gagcgaugaugacaccaaa

SEQ ID NO: 1586969 - RNA, 19 nt, Homo sapiens
caggagagcucgccaagca

SEQ ID NO: 1586970 - RNA, 19 nt, Homo sapiens
cauggaagauucgguguuu

SEQ ID NO: 1586971 - RNA, 19 nt, Homo sapiens
ggagaucugccacaauuug

SEQ ID NO: 1586972 - RNA, 19 nt, Homo sapiens
gaagugaagccaacaucaa

SEQ ID NO: 1586973 - RNA, 19 nt, Homo sapiens
gcgcacaccuucaccaaca

SEQ ID NO: 1586974 - RNA, 19 nt, Homo sapiens
cuaauuagcauguugcauu

SEQ ID NO: 1586975 - RNA, 19 nt, Homo sapiens
cgaagucucuggacaacau

SEQ ID NO: 1586976 - RNA, 19 nt, Homo sapiens
gcauuagcauggcacuuug

SEQ ID NO: 1586977 - RNA, 19 nt, Homo sapiens
cagcaggguuagcauuaaa

SEQ ID NO: 1586978 - RNA, 19 nt, Homo sapiens
agggagaucugccacaauu

SEQ ID NO: 1586979 - RNA, 19 nt, Homo sapiens
cuggagcacuauuuguuua

SEQ ID NO: 1586980 - RNA, 19 nt, Homo sapiens
cacuaaauguggaccagua

SEQ ID NO: 1586981 - RNA, 19 nt, Homo sapiens
ccauaucccuccucuucuu

SEQ ID NO: 1586982 - RNA, 19 nt, Homo sapiens
ggacagaaaagccuccuua

SEQ ID NO: 1586983 - RNA, 19 nt, Homo sapiens
gcuuagauuaccuagauua

SEQ ID NO: 1586984 - RNA, 19 nt, Homo sapiens
guauaucgguggcuucaag

SEQ ID NO: 1586985 - RNA, 19 nt, Homo sapiens
ccacagaccugagcagcau

SEQ ID NO: 1586986 - RNA, 19 nt, Homo sapiens
gagagugucccuccuagug

SEQ ID NO: 1586987 - RNA, 19 nt, Homo sapiens
uagccgaguucuacacuga

SEQ ID NO: 1586988 - RNA, 19 nt, Homo sapiens
ugacagagaggccuuggaa

SEQ ID NO: 1586989 - RNA, 19 nt, Homo sapiens
caacgcgcaguguguauuu

SEQ ID NO: 1586990 - RNA, 19 nt, Homo sapiens
gggcacagccaaggaauga

SEQ ID NO: 1586991 - RNA, 19 nt, Homo sapiens
agacagcaaugacuaugau

SEQ ID NO: 1586992 - RNA, 19 nt, Homo sapiens
ucacuggcccguuugcuuu

SEQ ID NO: 1586993 - RNA, 19 nt, Homo sapiens
gagaaucccagcaagaauc

SEQ ID NO: 1586994 - RNA, 19 nt, Homo sapiens
aagauucgguguuugucua

SEQ ID NO: 1586995 - RNA, 19 nt, Homo sapiens
gcgagaaucccagcaagaa

SEQ ID NO: 1586996 - RNA, 19 nt, Homo sapiens
caacugaugaacuuguauu

SEQ ID NO: 1586997 - RNA, 19 nt, Homo sapiens
ggacacgccaggcauggaa

SEQ ID NO: 1586998 - RNA, 19 nt, Homo sapiens
ucagaugaccuuuguguuc

SEQ ID NO: 1586999 - RNA, 19 nt, Homo sapiens
auuauuagcuacaguguuc

SEQ ID NO: 1587000 - RNA, 19 nt, Homo sapiens
aagaacugcuugacagaga

SEQ ID NO: 1587001 - RNA, 19 nt, Homo sapiens
gaugaccuuuguguucgua

SEQ ID NO: 1587002 - RNA, 19 nt, Homo sapiens
uaaggguacuugggaauca

SEQ ID NO: 1587003 - RNA, 19 nt, Homo sapiens
ggauuucccuuaggcaaca

SEQ ID NO: 1587004 - RNA, 19 nt, Homo sapiens
caggauacauaggaaguug

SEQ ID NO: 1587005 - RNA, 19 nt, Homo sapiens
gcgcauuacagaaagcuuu

SEQ ID NO: 1587006 - RNA, 19 nt, Homo sapiens
caggaaauccaaucagaug

SEQ ID NO: 1587007 - RNA, 19 nt, Homo sapiens
augcuaaguuucucccaua

SEQ ID NO: 1587008 - RNA, 19 nt, Homo sapiens
ccacaccgaacacuaaaug

SEQ ID NO: 1587009 - RNA, 19 nt, Homo sapiens
ccagggagaucugccacaa

SEQ ID NO: 1587010 - RNA, 19 nt, Homo sapiens
caacaucuggaucaguaaa

SEQ ID NO: 1587011 - RNA, 19 nt, Homo sapiens
gagaaaaggaugucauuau

SEQ ID NO: 1587012 - RNA, 19 nt, Homo sapiens
gcaugacacuccuggaaaa

SEQ ID NO: 1587013 - RNA, 19 nt, Homo sapiens
ucagcaacauucuagugaa

SEQ ID NO: 1587014 - RNA, 19 nt, Homo sapiens
cagcgcagccuguaacuuc

SEQ ID NO: 1587015 - RNA, 19 nt, Homo sapiens
uguuacaacugaugaacuu

SEQ ID NO: 1587016 - RNA, 19 nt, Homo sapiens
gaaaagccuccuuaaguga

SEQ ID NO: 1587017 - RNA, 19 nt, Homo sapiens
auagagggaugcagacuca

SEQ ID NO: 1587018 - RNA, 19 nt, Homo sapiens
gcggccaagugaaagguaa

SEQ ID NO: 1587019 - RNA, 19 nt, Homo sapiens
gcccagugcuagccgaguu

SEQ ID NO: 1587020 - RNA, 19 nt, Homo sapiens
cugagaagcccucgaauca

SEQ ID NO: 1587021 - RNA, 19 nt, Homo sapiens
uaacuucagcaacauucua

SEQ ID NO: 1587022 - RNA, 19 nt, Homo sapiens
gccgaguucuacacugaaa

SEQ ID NO: 1587023 - RNA, 19 nt, Homo sapiens
ggagggcacagccaaggaa

SEQ ID NO: 1587024 - RNA, 19 nt, Homo sapiens
acccuuggauuccggauaa

SEQ ID NO: 1587025 - RNA, 19 nt, Homo sapiens
gccuguaacuucagcaaca

SEQ ID NO: 1587026 - RNA, 19 nt, Homo sapiens
ccagggagcacaucguuuc

SEQ ID NO: 1587027 - RNA, 19 nt, Homo sapiens
uaaauguggaccaguauca

SEQ ID NO: 1587028 - RNA, 19 nt, Homo sapiens
ggaagcugaggacuuauuc

SEQ ID NO: 1587029 - RNA, 19 nt, Homo sapiens
agaaaagccuccuuaagug

SEQ ID NO: 1587030 - RNA, 19 nt, Homo sapiens
gcucgaagucucuggacaa

SEQ ID NO: 1587031 - RNA, 19 nt, Homo sapiens
ggccagacagcaaugacua

SEQ ID NO: 1587032 - RNA, 19 nt, Homo sapiens
gauucgguguuugucuaua

SEQ ID NO: 1587033 - RNA, 19 nt, Homo sapiens
uagcuacaguguucauagu

SEQ ID NO: 1587034 - RNA, 19 nt, Homo sapiens
ccucuucuuugcauauuuc

SEQ ID NO: 1587035 - RNA, 19 nt, Homo sapiens
cagaaaagccuccuuaagu

SEQ ID NO: 1587036 - RNA, 19 nt, Homo sapiens
ugugugcugugucaggaua

SEQ ID NO: 1587037 - RNA, 19 nt, Homo sapiens
ucaggaaugugugcugugu

SEQ ID NO: 1587038 - RNA, 19 nt, Homo sapiens
ucucagagcaucagcacuu

SEQ ID NO: 1587039 - RNA, 19 nt, Homo sapiens
gaugacaccaaauccaugu

SEQ ID NO: 1587040 - RNA, 19 nt, Homo sapiens
gcgaugaugacaccaaauc

SEQ ID NO: 1587041 - RNA, 19 nt, Homo sapiens
caagcacgagcgaugauga

SEQ ID NO: 1587042 - RNA, 19 nt, Homo sapiens
ucucugaccuggagcugau

SEQ ID NO: 1587043 - RNA, 19 nt, Homo sapiens
gaggacuuauuccgcuuuc

SEQ ID NO: 1587044 - RNA, 19 nt, Homo sapiens
aggaaugugugcuguguca

SEQ ID NO: 1587045 - RNA, 19 nt, Homo sapiens
gcccugagcagcuucacuu

SEQ ID NO: 1587046 - RNA, 19 nt, Homo sapiens
gagcagagggaggagaaga

SEQ ID NO: 1587047 - RNA, 19 nt, Homo sapiens
ggagcgagaaucccagcaa

SEQ ID NO: 1587048 - RNA, 19 nt, Homo sapiens
gcaguuuuauguuuacaga

SEQ ID NO: 1587049 - RNA, 19 nt, Homo sapiens
gaagauucgguguuugucu

SEQ ID NO: 1587050 - RNA, 19 nt, Homo sapiens
ggacuuauuccgcuuucca

SEQ ID NO: 1587051 - RNA, 19 nt, Homo sapiens
gaaaaucccugaucucuua

SEQ ID NO: 1587052 - RNA, 19 nt, Homo sapiens
ucacugagauagauacaua

SEQ ID NO: 1587053 - RNA, 19 nt, Homo sapiens
ggacagagguucaggaucu

SEQ ID NO: 1587054 - RNA, 19 nt, Homo sapiens
gaagagcccuagagcuuug

SEQ ID NO: 1587055 - RNA, 19 nt, Homo sapiens
gaagaagaauacagucaug

SEQ ID NO: 1587056 - RNA, 19 nt, Homo sapiens
ggagaaacuucccuuaauc

SEQ ID NO: 1587057 - RNA, 19 nt, Homo sapiens
gagagaauuucccagauug

SEQ ID NO: 1587058 - RNA, 19 nt, Homo sapiens
gaacaacacuggcgaugac

SEQ ID NO: 1587059 - RNA, 19 nt, Homo sapiens
gaccuuuguucucuuauuu

SEQ ID NO: 1587060 - RNA, 19 nt, Homo sapiens
gaaacuucccuuaaucaaa

SEQ ID NO: 1587061 - RNA, 19 nt, Homo sapiens
ggucuucccuguuuguuug

SEQ ID NO: 1587062 - RNA, 19 nt, Homo sapiens
ggaugacgcuccucugugu

SEQ ID NO: 1587063 - RNA, 19 nt, Homo sapiens
gaguuaaucuucucugauc

SEQ ID NO: 1587064 - RNA, 19 nt, Homo sapiens
uauaaacacagcacacuua

SEQ ID NO: 1587065 - RNA, 19 nt, Homo sapiens
uggaaaggcuaaucagaaa

SEQ ID NO: 1587066 - RNA, 19 nt, Homo sapiens
gcaguugaccgaaacauug

SEQ ID NO: 1587067 - RNA, 19 nt, Homo sapiens
ugagagaauuucccagauu

SEQ ID NO: 1587068 - RNA, 19 nt, Homo sapiens
uggcauagccuacugcaua

SEQ ID NO: 1587069 - RNA, 19 nt, Homo sapiens
agaaacaccuugaaguaug

SEQ ID NO: 1587070 - RNA, 19 nt, Homo sapiens
gcaaucaauuccuguucaa

SEQ ID NO: 1587071 - RNA, 19 nt, Homo sapiens
ggaaacuucuuagggcaaa

SEQ ID NO: 1587072 - RNA, 19 nt, Homo sapiens
gugaaggccuagggcauua

SEQ ID NO: 1587073 - RNA, 19 nt, Homo sapiens
ggacagggaggaugaggaa

SEQ ID NO: 1587074 - RNA, 19 nt, Homo sapiens
uuagaaacaccuugaagua

SEQ ID NO: 1587075 - RNA, 19 nt, Homo sapiens
gaucugaaagggaacauug

SEQ ID NO: 1587076 - RNA, 19 nt, Homo sapiens
uggagaaacuucccuuaau

SEQ ID NO: 1587077 - RNA, 19 nt, Homo sapiens
gggcauuacuguauacuac

SEQ ID NO: 1587078 - RNA, 19 nt, Homo sapiens
agaauuggcucuccuguac

SEQ ID NO: 1587079 - RNA, 19 nt, Homo sapiens
gcaugugacuacugaauac

SEQ ID NO: 1587080 - RNA, 19 nt, Homo sapiens
gaaacaccuugaaguaugc

SEQ ID NO: 1587081 - RNA, 19 nt, Homo sapiens
gaaggcagacuaugucaca

SEQ ID NO: 1587082 - RNA, 19 nt, Homo sapiens
ggaagagcccuagagcuuu

SEQ ID NO: 1587083 - RNA, 19 nt, Homo sapiens
gagaaacuucccuuaauca

SEQ ID NO: 1587084 - RNA, 19 nt, Homo sapiens
ugacagggacgcauucuga

SEQ ID NO: 1587085 - RNA, 19 nt, Homo sapiens
ccuagggcauuacuguaua

SEQ ID NO: 1587086 - RNA, 19 nt, Homo sapiens
gcacaaugggaaauauuug

SEQ ID NO: 1587087 - RNA, 19 nt, Homo sapiens
gcagcacaaugggaaauau

SEQ ID NO: 1587088 - RNA, 19 nt, Homo sapiens
gcaauaugaguuaaucuuc

SEQ ID NO: 1587089 - RNA, 19 nt, Homo sapiens
gcugagaguugcuccagau

SEQ ID NO: 1587090 - RNA, 19 nt, Homo sapiens
gagaguugcuccagaugag

SEQ ID NO: 1587091 - RNA, 19 nt, Homo sapiens
acaauuugcugaggucuga

SEQ ID NO: 1587092 - RNA, 19 nt, Homo sapiens
cccacucuauucaaaguua

SEQ ID NO: 1587093 - RNA, 19 nt, Homo sapiens
caaguccacuauaaaucuu

SEQ ID NO: 1587094 - RNA, 19 nt, Homo sapiens
ugucuuaugucucccuaaa

SEQ ID NO: 1587095 - RNA, 19 nt, Homo sapiens
cugcagcacuuaaccgaaa

SEQ ID NO: 1587096 - RNA, 19 nt, Homo sapiens
aaucuucucugaucgaugu

SEQ ID NO: 1587097 - RNA, 19 nt, Homo sapiens
acagggcacuuacuacgaa

SEQ ID NO: 1587098 - RNA, 19 nt, Homo sapiens
ugaauacuauaggcaauug

SEQ ID NO: 1587099 - RNA, 19 nt, Homo sapiens
ggaagagaaggcagacuau

SEQ ID NO: 1587100 - RNA, 19 nt, Homo sapiens
gcugucaucucuggaguga

SEQ ID NO: 1587101 - RNA, 19 nt, Homo sapiens
gcaaagggaugaggaugac

SEQ ID NO: 1587102 - RNA, 19 nt, Homo sapiens
cacagaggcugauggacaa

SEQ ID NO: 1587103 - RNA, 19 nt, Homo sapiens
aaacccaccucccacucua

SEQ ID NO: 1587104 - RNA, 19 nt, Homo sapiens
auagaccuuuguucucuua

SEQ ID NO: 1587105 - RNA, 19 nt, Homo sapiens
uauaugcaguugaccgaaa

SEQ ID NO: 1587106 - RNA, 19 nt, Homo sapiens
gucagugaguggugaauga

SEQ ID NO: 1587107 - RNA, 19 nt, Homo sapiens
ugaugagccuccuggguuu

SEQ ID NO: 1587108 - RNA, 19 nt, Homo sapiens
caaaccaauaggacaauuu

SEQ ID NO: 1587109 - RNA, 19 nt, Homo sapiens
ccuuggagcuggagaggaa

SEQ ID NO: 1587110 - RNA, 19 nt, Homo sapiens
gaaaggcuaaucagaaacu

SEQ ID NO: 1587111 - RNA, 19 nt, Homo sapiens
gauagaccuuuguucucuu

SEQ ID NO: 1587112 - RNA, 19 nt, Homo sapiens
acuguaggcuuuauaaaca

SEQ ID NO: 1587113 - RNA, 19 nt, Homo sapiens
cugcauaccuaggcuauau

SEQ ID NO: 1587114 - RNA, 19 nt, Homo sapiens
cagggacgcauucugauaa

SEQ ID NO: 1587115 - RNA, 19 nt, Homo sapiens
ggagaggaaacucacagaa

SEQ ID NO: 1587116 - RNA, 19 nt, Homo sapiens
cagcaugagcuaacuuuau

SEQ ID NO: 1587117 - RNA, 19 nt, Homo sapiens
gggaaauauuuguguaucu

SEQ ID NO: 1587118 - RNA, 19 nt, Homo sapiens
gaacucacccagcucuaca

SEQ ID NO: 1587119 - RNA, 19 nt, Homo sapiens
ggaacaacacuggcgauga

SEQ ID NO: 1587120 - RNA, 19 nt, Homo sapiens
gaaagggaacauugacaag

SEQ ID NO: 1587121 - RNA, 19 nt, Homo sapiens
gcauuacuguauacuacug

SEQ ID NO: 1587122 - RNA, 19 nt, Homo sapiens
aaaccgaggcuuacuggaa

SEQ ID NO: 1587123 - RNA, 19 nt, Homo sapiens
ugacaaaacccacaagaaa

SEQ ID NO: 1587124 - RNA, 19 nt, Homo sapiens
gugaagacguggagcuaca

SEQ ID NO: 1587125 - RNA, 19 nt, Homo sapiens
gaaagugaggcugguguug

SEQ ID NO: 1587126 - RNA, 19 nt, Homo sapiens
gcucaaaccaauaggacaa

SEQ ID NO: 1587127 - RNA, 19 nt, Homo sapiens
gaagcucccuccccacuga

SEQ ID NO: 1587128 - RNA, 19 nt, Homo sapiens
cggcaugccuucuguuucu

SEQ ID NO: 1587129 - RNA, 19 nt, Homo sapiens
uaagggagcauguguggau

SEQ ID NO: 1587130 - RNA, 19 nt, Homo sapiens
gaagagaaggcagacuaug

SEQ ID NO: 1587131 - RNA, 19 nt, Homo sapiens
gagaauuucccagauugaa

SEQ ID NO: 1587132 - RNA, 19 nt, Homo sapiens
agcaugagcuaacuuuaug

SEQ ID NO: 1587133 - RNA, 19 nt, Homo sapiens
ccacaugucaucaggacuu

SEQ ID NO: 1587134 - RNA, 19 nt, Homo sapiens
uggaagagcccuagagcuu

SEQ ID NO: 1587135 - RNA, 19 nt, Homo sapiens
gcacucagcaugccaaagc

SEQ ID NO: 1587136 - RNA, 19 nt, Homo sapiens
uacagcaugugacuacuga

SEQ ID NO: 1587137 - RNA, 19 nt, Homo sapiens
ccuguuuguuuguuuguuu

SEQ ID NO: 1587138 - RNA, 19 nt, Homo sapiens
agaggaaacucacagaacu

SEQ ID NO: 1587139 - RNA, 19 nt, Homo sapiens
aaaccaauaggacaauuug

SEQ ID NO: 1587140 - RNA, 19 nt, Homo sapiens
cugauugccuccuuuggaa

SEQ ID NO: 1587141 - RNA, 19 nt, Homo sapiens
aaacucaagcuuagggaaa

SEQ ID NO: 1587142 - RNA, 19 nt, Homo sapiens
gaaggagcaaggacaaagu

SEQ ID NO: 1587143 - RNA, 19 nt, Homo sapiens
gcuaugacuuggccacucu

SEQ ID NO: 1587144 - RNA, 19 nt, Homo sapiens
ucaaaccaauaggacaauu

SEQ ID NO: 1587145 - RNA, 19 nt, Homo sapiens
caaaagaaugcaacuguuu

SEQ ID NO: 1587146 - RNA, 19 nt, Homo sapiens
cagcagugggucagagaua

SEQ ID NO: 1587147 - RNA, 19 nt, Homo sapiens
ugaaagggaacauugacaa

SEQ ID NO: 1587148 - RNA, 19 nt, Homo sapiens
gcaccuguacagcauguga

SEQ ID NO: 1587149 - RNA, 19 nt, Homo sapiens
uagaaacaccuugaaguau

SEQ ID NO: 1587150 - RNA, 19 nt, Homo sapiens
cgcagacgauauugacaaa

SEQ ID NO: 1587151 - RNA, 19 nt, Homo sapiens
uaaagucucuucacauuga

SEQ ID NO: 1587152 - RNA, 19 nt, Homo sapiens
gcacaguagucaccaauga

SEQ ID NO: 1587153 - RNA, 19 nt, Homo sapiens
gaacuggaaugccauagau

SEQ ID NO: 1587154 - RNA, 19 nt, Homo sapiens
cgaaguauguggaauuuau

SEQ ID NO: 1587155 - RNA, 19 nt, Homo sapiens
ccacuuaacuggauuucuu

SEQ ID NO: 1587156 - RNA, 19 nt, Homo sapiens
gaacagcacaggcuucuug

SEQ ID NO: 1587157 - RNA, 19 nt, Homo sapiens
ggacuguacuauucccuuu

SEQ ID NO: 1587158 - RNA, 19 nt, Homo sapiens
ccagugcacuuugccauua

SEQ ID NO: 1587159 - RNA, 19 nt, Homo sapiens
uaucaggugucuauaauug

SEQ ID NO: 1587160 - RNA, 19 nt, Homo sapiens
caacagaggugaaacuacu

SEQ ID NO: 1587161 - RNA, 19 nt, Homo sapiens
gagggaagcuggaaucucu

SEQ ID NO: 1587162 - RNA, 19 nt, Homo sapiens
gaggagcaccggaucaaua

SEQ ID NO: 1587163 - RNA, 19 nt, Homo sapiens
gaacuugagguagccauua

SEQ ID NO: 1587164 - RNA, 19 nt, Homo sapiens
ccaaauacauugucuuaac

SEQ ID NO: 1587165 - RNA, 19 nt, Homo sapiens
ucaggugucuauaauugua

SEQ ID NO: 1587166 - RNA, 19 nt, Homo sapiens
gagaagcuauuuaugaaac

SEQ ID NO: 1587167 - RNA, 19 nt, Homo sapiens
gaggaaaucuuuugaugaa

SEQ ID NO: 1587168 - RNA, 19 nt, Homo sapiens
gauaauuacccuccuaguu

SEQ ID NO: 1587169 - RNA, 19 nt, Homo sapiens
ggaacuaucaggugucuau

SEQ ID NO: 1587170 - RNA, 19 nt, Homo sapiens
uggagaagcuauuuaugaa

SEQ ID NO: 1587171 - RNA, 19 nt, Homo sapiens
ggacaucuuuugccacaua

SEQ ID NO: 1587172 - RNA, 19 nt, Homo sapiens
ugccagagcucuaugaguu

SEQ ID NO: 1587173 - RNA, 19 nt, Homo sapiens
ggaccacuauuuacagcaa

SEQ ID NO: 1587174 - RNA, 19 nt, Homo sapiens
gaagcaacuuguagagaca

SEQ ID NO: 1587175 - RNA, 19 nt, Homo sapiens
auaauuacccuccuaguuu

SEQ ID NO: 1587176 - RNA, 19 nt, Homo sapiens
ggagaaagcaaauguaaaa

SEQ ID NO: 1587177 - RNA, 19 nt, Homo sapiens
caaacaucaugaaggcuuu

SEQ ID NO: 1587178 - RNA, 19 nt, Homo sapiens
aaagauaauuacccuccua

SEQ ID NO: 1587179 - RNA, 19 nt, Homo sapiens
cugacuaucuuacaauuga

SEQ ID NO: 1587180 - RNA, 19 nt, Homo sapiens
gaaagcaaauguaaaacug

SEQ ID NO: 1587181 - RNA, 19 nt, Homo sapiens
gcucuagcccuaacuaaug

SEQ ID NO: 1587182 - RNA, 19 nt, Homo sapiens
gcacauggagaaagcaaau

SEQ ID NO: 1587183 - RNA, 19 nt, Homo sapiens
ggagaagcuauuuaugaaa

SEQ ID NO: 1587184 - RNA, 19 nt, Homo sapiens
ugucuuaacuuccaaacau

SEQ ID NO: 1587185 - RNA, 19 nt, Homo sapiens
guagaacugccacagcuaa

SEQ ID NO: 1587186 - RNA, 19 nt, Homo sapiens
ggccauggacagccacuua

SEQ ID NO: 1587187 - RNA, 19 nt, Homo sapiens
aagcggcaauuuccaguuu

SEQ ID NO: 1587188 - RNA, 19 nt, Homo sapiens
uaauuacccuccuaguuuc

SEQ ID NO: 1587189 - RNA, 19 nt, Homo sapiens
caauggagaagcuauuuau

SEQ ID NO: 1587190 - RNA, 19 nt, Homo sapiens
uggaaucucugacuaucuu

SEQ ID NO: 1587191 - RNA, 19 nt, Homo sapiens
gagcugguagcaucuguaa

SEQ ID NO: 1587192 - RNA, 19 nt, Homo sapiens
ccauuaaagucucuucaca

SEQ ID NO: 1587193 - RNA, 19 nt, Homo sapiens
uggcugaugcugcaaguua

SEQ ID NO: 1587194 - RNA, 19 nt, Homo sapiens
gcgagugguucugguggua

SEQ ID NO: 1587195 - RNA, 19 nt, Homo sapiens
cagcuaaccauucaucaga

SEQ ID NO: 1587196 - RNA, 19 nt, Homo sapiens
ucaauggagaagcuauuua

SEQ ID NO: 1587197 - RNA, 19 nt, Homo sapiens
gaauauugggcccacacua

SEQ ID NO: 1587198 - RNA, 19 nt, Homo sapiens
gaacugaccugcguuuugg

SEQ ID NO: 1587199 - RNA, 19 nt, Homo sapiens
ugccaaauacauugucuua

SEQ ID NO: 1587200 - RNA, 19 nt, Homo sapiens
ccuccuaguuucaaauaug

SEQ ID NO: 1587201 - RNA, 19 nt, Homo sapiens
gaacuaucaggugucuaua

SEQ ID NO: 1587202 - RNA, 19 nt, Homo sapiens
gacagccacuuaacuggau

SEQ ID NO: 1587203 - RNA, 19 nt, Homo sapiens
ggaacuggaaugccauaga

SEQ ID NO: 1587204 - RNA, 19 nt, Homo sapiens
gagugguucuggugguauu

SEQ ID NO: 1587205 - RNA, 19 nt, Homo sapiens
ggcaauuuccaguuucuaa

SEQ ID NO: 1587206 - RNA, 19 nt, Homo sapiens
gaaguauguggaauuuaug

SEQ ID NO: 1587207 - RNA, 19 nt, Homo sapiens
uuaacuggauuucuuugga

SEQ ID NO: 1587208 - RNA, 19 nt, Homo sapiens
aagcuggaaucucugacua

SEQ ID NO: 1587209 - RNA, 19 nt, Homo sapiens
ucuaugaguuagugaacaa

SEQ ID NO: 1587210 - RNA, 19 nt, Homo sapiens
guacacauccaagccuaaa

SEQ ID NO: 1587211 - RNA, 19 nt, Homo sapiens
guagagacaguuucaugug

SEQ ID NO: 1587212 - RNA, 19 nt, Homo sapiens
gccagagcucuaugaguua

SEQ ID NO: 1587213 - RNA, 19 nt, Homo sapiens
acuaucaggugucuauaau

SEQ ID NO: 1587214 - RNA, 19 nt, Homo sapiens
gcuggaaucucugacuauc

SEQ ID NO: 1587215 - RNA, 19 nt, Homo sapiens
ggucagaauauucguggaa

SEQ ID NO: 1587216 - RNA, 19 nt, Homo sapiens
gccaaccagugggcagaua

SEQ ID NO: 1587217 - RNA, 19 nt, Homo sapiens
guucagcccuuucccuuuu

SEQ ID NO: 1587218 - RNA, 19 nt, Homo sapiens
ugccacagcuaaccauuca

SEQ ID NO: 1587219 - RNA, 19 nt, Homo sapiens
caagugggguccuggcuaa

SEQ ID NO: 1587220 - RNA, 19 nt, Homo sapiens
ucaggccucuggugccaaa

SEQ ID NO: 1587221 - RNA, 19 nt, Homo sapiens
gcaugacaauagacaaacu

SEQ ID NO: 1587222 - RNA, 19 nt, Homo sapiens
gaaaacugcaugacaauag

SEQ ID NO: 1587223 - RNA, 19 nt, Homo sapiens
uaacuuccaaacaucauga

SEQ ID NO: 1587224 - RNA, 19 nt, Homo sapiens
cagugcacuuugccauuaa

SEQ ID NO: 1587225 - RNA, 19 nt, Homo sapiens
gauuuuggaccacuauuua

SEQ ID NO: 1587226 - RNA, 19 nt, Homo sapiens
gaccacuauuuacagcaaa

SEQ ID NO: 1587227 - RNA, 19 nt, Homo sapiens
aggaaaagauaccgaagua

SEQ ID NO: 1587228 - RNA, 19 nt, Homo sapiens
caauuuccaguuucuaaga

SEQ ID NO: 1587229 - RNA, 19 nt, Homo sapiens
gaaacuacugggccaugga

SEQ ID NO: 1587230 - RNA, 19 nt, Homo sapiens
ccuaacuaaugugaucuaa

SEQ ID NO: 1587231 - RNA, 19 nt, Homo sapiens
acacauccaagccuaaaga

SEQ ID NO: 1587232 - RNA, 19 nt, Homo sapiens
gaauuggugaagcaacuug

SEQ ID NO: 1587233 - RNA, 19 nt, Homo sapiens
ggaaucucugacuaucuua

SEQ ID NO: 1587234 - RNA, 19 nt, Homo sapiens
ccagagcucuaugaguuag

SEQ ID NO: 1587235 - RNA, 19 nt, Homo sapiens
gaacugccacagcuaacca

SEQ ID NO: 1587236 - RNA, 19 nt, Homo sapiens
ucauguggaggaaaucuuu

SEQ ID NO: 1587237 - RNA, 19 nt, Homo sapiens
caaccagugggcagauauu

SEQ ID NO: 1587238 - RNA, 19 nt, Homo sapiens
caugguggcuucuauaccu

SEQ ID NO: 1587239 - RNA, 19 nt, Homo sapiens
gcaaauguaaaacuggaua

SEQ ID NO: 1587240 - RNA, 19 nt, Homo sapiens
cuccuaguuucaaauauga

SEQ ID NO: 1587241 - RNA, 19 nt, Homo sapiens
uggccugguuauauaauga

SEQ ID NO: 1587242 - RNA, 19 nt, Homo sapiens
gcaauuuccaguuucuaag

SEQ ID NO: 1587243 - RNA, 19 nt, Homo sapiens
gguuugaccaggccaaguu

SEQ ID NO: 1587244 - RNA, 19 nt, Homo sapiens
ggaacuugagguagccauu

SEQ ID NO: 1587245 - RNA, 19 nt, Homo sapiens
cacauugauuuguuuccaa

SEQ ID NO: 1587246 - RNA, 19 nt, Homo sapiens
ugucuaaggcuaggaacua

SEQ ID NO: 1587247 - RNA, 19 nt, Homo sapiens
ucagaugccguguaaaugg

SEQ ID NO: 1587248 - RNA, 19 nt, Homo sapiens
gccauggacagccacuuaa

SEQ ID NO: 1587249 - RNA, 19 nt, Homo sapiens
cauccaagccuaaagaaaa

SEQ ID NO: 1587250 - RNA, 19 nt, Homo sapiens
gagcaccggaucaauacug

SEQ ID NO: 1587251 - RNA, 19 nt, Homo sapiens
gaccaaggauucagcauua

SEQ ID NO: 1587252 - RNA, 19 nt, Homo sapiens
gcagaaagcuggacagaca

SEQ ID NO: 1587253 - RNA, 19 nt, Homo sapiens
ccaagaagcugauugauuc

SEQ ID NO: 1587254 - RNA, 19 nt, Homo sapiens
ggaagaagcccaaggauga

SEQ ID NO: 1587255 - RNA, 19 nt, Homo sapiens
gaaacaucaugguguauaa

SEQ ID NO: 1587256 - RNA, 19 nt, Homo sapiens
caagaaacaucauggugua

SEQ ID NO: 1587257 - RNA, 19 nt, Homo sapiens
gaaaacaucugaacaaguu

SEQ ID NO: 1587258 - RNA, 19 nt, Homo sapiens
gaucacaaauggcaagaaa

SEQ ID NO: 1587259 - RNA, 19 nt, Homo sapiens
ucacaaagcuaugguguuu

SEQ ID NO: 1587260 - RNA, 19 nt, Homo sapiens
agaaauaucugguacuuug

SEQ ID NO: 1587261 - RNA, 19 nt, Homo sapiens
gaaguugaguaccauguaa

SEQ ID NO: 1587262 - RNA, 19 nt, Homo sapiens
gaacuaagaaguacguauu

SEQ ID NO: 1587263 - RNA, 19 nt, Homo sapiens
gaaaggaauucuucgaaca

SEQ ID NO: 1587264 - RNA, 19 nt, Homo sapiens
gaagcugauugauucuuua

SEQ ID NO: 1587265 - RNA, 19 nt, Homo sapiens
uaaaugauaucacgccaaa

SEQ ID NO: 1587266 - RNA, 19 nt, Homo sapiens
caacuaaacccugaagaua

SEQ ID NO: 1587267 - RNA, 19 nt, Homo sapiens
gagaugcuguucaguuaaa

SEQ ID NO: 1587268 - RNA, 19 nt, Homo sapiens
ucacaaauggcaagaaaua

SEQ ID NO: 1587269 - RNA, 19 nt, Homo sapiens
aagagaugcuguucaguua

SEQ ID NO: 1587270 - RNA, 19 nt, Homo sapiens
gaacaucuauacauauggu

SEQ ID NO: 1587271 - RNA, 19 nt, Homo sapiens
ugaagaaucuggaaguguu

SEQ ID NO: 1587272 - RNA, 19 nt, Homo sapiens
caagaaauaucugguacuu

SEQ ID NO: 1587273 - RNA, 19 nt, Homo sapiens
auaaagaggugaucauaga

SEQ ID NO: 1587274 - RNA, 19 nt, Homo sapiens
guaaggccaucgauuguug

SEQ ID NO: 1587275 - RNA, 19 nt, Homo sapiens
gauggaugauggccuagua

SEQ ID NO: 1587276 - RNA, 19 nt, Homo sapiens
gcaagcauauugaugaagu

SEQ ID NO: 1587277 - RNA, 19 nt, Homo sapiens
agaaguacguauugaauga

SEQ ID NO: 1587278 - RNA, 19 nt, Homo sapiens
gagacagaccuaauacaua

SEQ ID NO: 1587279 - RNA, 19 nt, Homo sapiens
gcauaugccuacuguaauc

SEQ ID NO: 1587280 - RNA, 19 nt, Homo sapiens
cagcauuccuguaugauau

SEQ ID NO: 1587281 - RNA, 19 nt, Homo sapiens
cagcauaugccuacuguaa

SEQ ID NO: 1587282 - RNA, 19 nt, Homo sapiens
gcaguuacauugggcagaa

SEQ ID NO: 1587283 - RNA, 19 nt, Homo sapiens
caggauggauugauaacuu

SEQ ID NO: 1587284 - RNA, 19 nt, Homo sapiens
ggaauauacguuaugguuu

SEQ ID NO: 1587285 - RNA, 19 nt, Homo sapiens
gaacaaguugcggaauaua

SEQ ID NO: 1587286 - RNA, 19 nt, Homo sapiens
acuaaacccugaagauaaa

SEQ ID NO: 1587287 - RNA, 19 nt, Homo sapiens
ggcagaauauguuguacaa

SEQ ID NO: 1587288 - RNA, 19 nt, Homo sapiens
gcuguucaguuaaauguga

SEQ ID NO: 1587289 - RNA, 19 nt, Homo sapiens
agacagaccuaauacauac

SEQ ID NO: 1587290 - RNA, 19 nt, Homo sapiens
guuaauagaccaagaaaca

SEQ ID NO: 1587291 - RNA, 19 nt, Homo sapiens
gaugauggccuaguaaaug

SEQ ID NO: 1587292 - RNA, 19 nt, Homo sapiens
gcauauugaugaaguaguc

SEQ ID NO: 1587293 - RNA, 19 nt, Homo sapiens
caaaagcauuggcagaaua

SEQ ID NO: 1587294 - RNA, 19 nt, Homo sapiens
gcagcuacaguaagguuua

SEQ ID NO: 1587295 - RNA, 19 nt, Homo sapiens
cugaacaaguugcggaaua

SEQ ID NO: 1587296 - RNA, 19 nt, Homo sapiens
gcuaugguguuucuugaau

SEQ ID NO: 1587297 - RNA, 19 nt, Homo sapiens
uaagagaugcuguucaguu

SEQ ID NO: 1587298 - RNA, 19 nt, Homo sapiens
cguauugaaugaagaaaug

SEQ ID NO: 1587299 - RNA, 19 nt, Homo sapiens
aaucuaaccuccaaucauc

SEQ ID NO: 1587300 - RNA, 19 nt, Homo sapiens
gaacaauacgugccuccaa

SEQ ID NO: 1587301 - RNA, 19 nt, Homo sapiens
caaguggucucuuuauugc

SEQ ID NO: 1587302 - RNA, 19 nt, Homo sapiens
ccaaguggucucuuuauug

SEQ ID NO: 1587303 - RNA, 19 nt, Homo sapiens
ggagacagaccuaauacau

SEQ ID NO: 1587304 - RNA, 19 nt, Homo sapiens
gacauuaaaccaucuuaga

SEQ ID NO: 1587305 - RNA, 19 nt, Homo sapiens
caacaaugcccuugcagau

SEQ ID NO: 1587306 - RNA, 19 nt, Homo sapiens
caagcauauugaugaagua

SEQ ID NO: 1587307 - RNA, 19 nt, Homo sapiens
gaaguguucaugcauguau

SEQ ID NO: 1587308 - RNA, 19 nt, Homo sapiens
ugaacaaguugcggaauau

SEQ ID NO: 1587309 - RNA, 19 nt, Homo sapiens
gcacaacaaaugaagaauc

SEQ ID NO: 1587310 - RNA, 19 nt, Homo sapiens
gaacucacccaaccuaaac

SEQ ID NO: 1587311 - RNA, 19 nt, Homo sapiens
ggaguuaauagaccaagaa

SEQ ID NO: 1587312 - RNA, 19 nt, Homo sapiens
cuaaauguggcaauuguaa

SEQ ID NO: 1587313 - RNA, 19 nt, Homo sapiens
guucaugcauguaucaaca

SEQ ID NO: 1587314 - RNA, 19 nt, Homo sapiens
cuauacauauggugaucua

SEQ ID NO: 1587315 - RNA, 19 nt, Homo sapiens
cacaacaaaugaagaaucu

SEQ ID NO: 1587316 - RNA, 19 nt, Homo sapiens
ggauugcuguaagccauaa

SEQ ID NO: 1587317 - RNA, 19 nt, Homo sapiens
cauguaauuuccacuuuca

SEQ ID NO: 1587318 - RNA, 19 nt, Homo sapiens
gggaaaggaauucuucgaa

SEQ ID NO: 1587319 - RNA, 19 nt, Homo sapiens
gcagggaaaggaauucuuc

SEQ ID NO: 1587320 - RNA, 19 nt, Homo sapiens
gcugauugauucuuuagag

SEQ ID NO: 1587321 - RNA, 19 nt, Homo sapiens
cugagaaugucaauauguu

SEQ ID NO: 1587322 - RNA, 19 nt, Homo sapiens
ggaauucuucgaacaauac

SEQ ID NO: 1587323 - RNA, 19 nt, Homo sapiens
gcauguaucaacagcauau

SEQ ID NO: 1587324 - RNA, 19 nt, Homo sapiens
gauaaagaggugaucauag

SEQ ID NO: 1587325 - RNA, 19 nt, Homo sapiens
guccuaaggugaauucagu

SEQ ID NO: 1587326 - RNA, 19 nt, Homo sapiens
acaaagcuaugguguuucu

SEQ ID NO: 1587327 - RNA, 19 nt, Homo sapiens
uaacucgucuucacaaagc

SEQ ID NO: 1587328 - RNA, 19 nt, Homo sapiens
gcugaggucuuguccuaag

SEQ ID NO: 1587329 - RNA, 19 nt, Homo sapiens
gcaacgcgacagcuuauuc

SEQ ID NO: 1587330 - RNA, 19 nt, Homo sapiens
cggaauauacguuaugguu

SEQ ID NO: 1587331 - RNA, 19 nt, Homo sapiens
auacgugccuccaacaaug

SEQ ID NO: 1587332 - RNA, 19 nt, Homo sapiens
ggauggauugauaacuuua

SEQ ID NO: 1587333 - RNA, 19 nt, Homo sapiens
uugcugaggucuuguccua

SEQ ID NO: 1587334 - RNA, 19 nt, Homo sapiens
gaagauaaagaggugauca

SEQ ID NO: 1587335 - RNA, 19 nt, Homo sapiens
acauugggcagaauauaua

SEQ ID NO: 1587336 - RNA, 19 nt, Homo sapiens
gauaucuaccucaggauga

SEQ ID NO: 1587337 - RNA, 19 nt, Homo sapiens
acaaugcccuugcagaucu

SEQ ID NO: 1587338 - RNA, 19 nt, Homo sapiens
ucacaggagcuaccgguuu

SEQ ID NO: 1587339 - RNA, 19 nt, Homo sapiens
gggcagaauauauagagaa

SEQ ID NO: 1587340 - RNA, 19 nt, Homo sapiens
cuaugguguuucuugaaua

SEQ ID NO: 1587341 - RNA, 19 nt, Homo sapiens
guaauuuccacuuucaaga

SEQ ID NO: 1587342 - RNA, 19 nt, Homo sapiens
guacaacaggcagcacuaa

SEQ ID NO: 1587343 - RNA, 19 nt, Homo sapiens
ggauugauaacuuuaaugg

SEQ ID NO: 1587344 - RNA, 19 nt, Homo sapiens
cagcuacaguaagguuuaa

SEQ ID NO: 1587345 - RNA, 19 nt, Homo sapiens
ggauucagcauuagaacau

SEQ ID NO: 1587346 - RNA, 19 nt, Homo sapiens
caaggauucagcauuagaa

SEQ ID NO: 1587347 - RNA, 19 nt, Homo sapiens
guacguauugaaugaagaa

SEQ ID NO: 1587348 - RNA, 19 nt, Homo sapiens
ucagacggcccaauguaaa

SEQ ID NO: 1587349 - RNA, 19 nt, Homo sapiens
uguaaucgcaagcauauug

SEQ ID NO: 1587350 - RNA, 19 nt, Homo sapiens
caaauggcaagaaauaucu

SEQ ID NO: 1587351 - RNA, 19 nt, Homo sapiens
gaaauacagucuccacuua

SEQ ID NO: 1587352 - RNA, 19 nt, Homo sapiens
gaaauuugcugcugauaug

SEQ ID NO: 1587353 - RNA, 19 nt, Homo sapiens
gagaagggaccaaguauua

SEQ ID NO: 1587354 - RNA, 19 nt, Homo sapiens
gaaauuaucugacaaagac

SEQ ID NO: 1587355 - RNA, 19 nt, Homo sapiens
ggagaaguguucauuauug

SEQ ID NO: 1587356 - RNA, 19 nt, Homo sapiens
gagaauuacuggaaaguuu

SEQ ID NO: 1587357 - RNA, 19 nt, Homo sapiens
caagaagaaugcagaaauu

SEQ ID NO: 1587358 - RNA, 19 nt, Homo sapiens
gagaggaaguguaaugauu

SEQ ID NO: 1587359 - RNA, 19 nt, Homo sapiens
gaacugacuuugcacuuug

SEQ ID NO: 1587360 - RNA, 19 nt, Homo sapiens
ggagaaggauuucaguuug

SEQ ID NO: 1587361 - RNA, 19 nt, Homo sapiens
acaaaggguucuucuaaua

SEQ ID NO: 1587362 - RNA, 19 nt, Homo sapiens
gaagauggauggaauaaac

SEQ ID NO: 1587363 - RNA, 19 nt, Homo sapiens
acagagagcugaagaaaug

SEQ ID NO: 1587364 - RNA, 19 nt, Homo sapiens
guaaacagcuuuguacaga

SEQ ID NO: 1587365 - RNA, 19 nt, Homo sapiens
agaaagccguugaauguua

SEQ ID NO: 1587366 - RNA, 19 nt, Homo sapiens
uugcaaagcuguauuauga

SEQ ID NO: 1587367 - RNA, 19 nt, Homo sapiens
gcaaugagaggaaguguaa

SEQ ID NO: 1587368 - RNA, 19 nt, Homo sapiens
gaugaagaaucuguuguua

SEQ ID NO: 1587369 - RNA, 19 nt, Homo sapiens
gaagaagacgcacacauaa

SEQ ID NO: 1587370 - RNA, 19 nt, Homo sapiens
gcagcggucuuaauucuuu

SEQ ID NO: 1587371 - RNA, 19 nt, Homo sapiens
aaccagagcuugaagauuu

SEQ ID NO: 1587372 - RNA, 19 nt, Homo sapiens
gaagaugcuuuggaugaua

SEQ ID NO: 1587373 - RNA, 19 nt, Homo sapiens
gaauuaaacccaacacaaa

SEQ ID NO: 1587374 - RNA, 19 nt, Homo sapiens
caacuggaauuuaggcuuu

SEQ ID NO: 1587375 - RNA, 19 nt, Homo sapiens
gcugauggauuuaaauuug

SEQ ID NO: 1587376 - RNA, 19 nt, Homo sapiens
gaagaaaccacaagagaga

SEQ ID NO: 1587377 - RNA, 19 nt, Homo sapiens
gaaagggacagaaagagua

SEQ ID NO: 1587378 - RNA, 19 nt, Homo sapiens
gaucggaauucuuuacuga

SEQ ID NO: 1587379 - RNA, 19 nt, Homo sapiens
guaaauaugcugcaguuaa

SEQ ID NO: 1587380 - RNA, 19 nt, Homo sapiens
ucccaaagcucacagauuu

SEQ ID NO: 1587381 - RNA, 19 nt, Homo sapiens
gagccgacaugaagaguuu

SEQ ID NO: 1587382 - RNA, 19 nt, Homo sapiens
ggaacugacuuugcacuuu

SEQ ID NO: 1587383 - RNA, 19 nt, Homo sapiens
guaagucaguggaaagaaa

SEQ ID NO: 1587384 - RNA, 19 nt, Homo sapiens
ccacaaaggguucuucuaa

SEQ ID NO: 1587385 - RNA, 19 nt, Homo sapiens
aggaauaucuggagucuuu

SEQ ID NO: 1587386 - RNA, 19 nt, Homo sapiens
gcacuuugguuacacagaa

SEQ ID NO: 1587387 - RNA, 19 nt, Homo sapiens
aaagaacucugauaucgaa

SEQ ID NO: 1587388 - RNA, 19 nt, Homo sapiens
gaccagggacuaccuaaua

SEQ ID NO: 1587389 - RNA, 19 nt, Homo sapiens
ggaauucauugccugcuuu

SEQ ID NO: 1587390 - RNA, 19 nt, Homo sapiens
gcaggaaaauagagaauua

SEQ ID NO: 1587391 - RNA, 19 nt, Homo sapiens
ucucauauaucucgucuuu

SEQ ID NO: 1587392 - RNA, 19 nt, Homo sapiens
gaagagaacaaguacuaaa

SEQ ID NO: 1587393 - RNA, 19 nt, Homo sapiens
gaagggccguggugugauu

SEQ ID NO: 1587394 - RNA, 19 nt, Homo sapiens
caaacuguguuguucuuaa

SEQ ID NO: 1587395 - RNA, 19 nt, Homo sapiens
cagcuaaccuggaauacuu

SEQ ID NO: 1587396 - RNA, 19 nt, Homo sapiens
gaauaugauuugccaacaa

SEQ ID NO: 1587397 - RNA, 19 nt, Homo sapiens
ugaagaagacgcacacaua

SEQ ID NO: 1587398 - RNA, 19 nt, Homo sapiens
gaagaacaguauuccugaa

SEQ ID NO: 1587399 - RNA, 19 nt, Homo sapiens
gaguggaucugaaagcaaa

SEQ ID NO: 1587400 - RNA, 19 nt, Homo sapiens
ggaaaagccucuugaaaau

SEQ ID NO: 1587401 - RNA, 19 nt, Homo sapiens
cgacagaagucaaugaaag

SEQ ID NO: 1587402 - RNA, 19 nt, Homo sapiens
gaacagagcgagaccuugu

SEQ ID NO: 1587403 - RNA, 19 nt, Homo sapiens
gaagccagguagugaaaga

SEQ ID NO: 1587404 - RNA, 19 nt, Homo sapiens
gaugauagugucaguagua

SEQ ID NO: 1587405 - RNA, 19 nt, Homo sapiens
agaaagaaaugcaggaguu

SEQ ID NO: 1587406 - RNA, 19 nt, Homo sapiens
gaagggaccaaguauuaaa

SEQ ID NO: 1587407 - RNA, 19 nt, Homo sapiens
gcaaguagcccugugagaa

SEQ ID NO: 1587408 - RNA, 19 nt, Homo sapiens
aaacagcuuuguacagaaa

SEQ ID NO: 1587409 - RNA, 19 nt, Homo sapiens
gcugauauguugaguuugu

SEQ ID NO: 1587410 - RNA, 19 nt, Homo sapiens
gaguugaggugauuucaug

SEQ ID NO: 1587411 - RNA, 19 nt, Homo sapiens
gcauuuagcuguucguuuu

SEQ ID NO: 1587412 - RNA, 19 nt, Homo sapiens
gcaaagcuguauuaugaag

SEQ ID NO: 1587413 - RNA, 19 nt, Homo sapiens
agaguggacugaaagauuu

SEQ ID NO: 1587414 - RNA, 19 nt, Homo sapiens
gcgaagagaacaaguacua

SEQ ID NO: 1587415 - RNA, 19 nt, Homo sapiens
ggaaauagaggcaaccaau

SEQ ID NO: 1587416 - RNA, 19 nt, Homo sapiens
caaaugcgccugaaucaau

SEQ ID NO: 1587417 - RNA, 19 nt, Homo sapiens
gcacauguugcuaagcuua

SEQ ID NO: 1587418 - RNA, 19 nt, Homo sapiens
gacaugaguuugcaaaaua

SEQ ID NO: 1587419 - RNA, 19 nt, Homo sapiens
uacagacccuuaaggaaua

SEQ ID NO: 1587420 - RNA, 19 nt, Homo sapiens
guacagacccuuaaggaau

SEQ ID NO: 1587421 - RNA, 19 nt, Homo sapiens
aggaacagcuucuagauug

SEQ ID NO: 1587422 - RNA, 19 nt, Homo sapiens
aaugugaacugucaaagaa

SEQ ID NO: 1587423 - RNA, 19 nt, Homo sapiens
guuccaagaccaaagauua

SEQ ID NO: 1587424 - RNA, 19 nt, Homo sapiens
ggaauuaaacccaacacaa

SEQ ID NO: 1587425 - RNA, 19 nt, Homo sapiens
gauccaaacuguguuguuc

SEQ ID NO: 1587426 - RNA, 19 nt, Homo sapiens
gaugagaagggaccaagua

SEQ ID NO: 1587427 - RNA, 19 nt, Homo sapiens
gaaacuaaauagcaguaag

SEQ ID NO: 1587428 - RNA, 19 nt, Homo sapiens
caaaauaccuucagaaaac

SEQ ID NO: 1587429 - RNA, 19 nt, Homo sapiens
guuauaugaugcucuguuu

SEQ ID NO: 1587430 - RNA, 19 nt, Homo sapiens
gaaguccugcaauuuauaa

SEQ ID NO: 1587431 - RNA, 19 nt, Homo sapiens
gagagacuucuuccuguua

SEQ ID NO: 1587432 - RNA, 19 nt, Homo sapiens
gagagaagucugcagcuaa

SEQ ID NO: 1587433 - RNA, 19 nt, Homo sapiens
agagaaagccguugaaugu

SEQ ID NO: 1587434 - RNA, 19 nt, Homo sapiens
gggaagaugcuuuggauga

SEQ ID NO: 1587435 - RNA, 19 nt, Homo sapiens
gaagaaugcagaaauuauc

SEQ ID NO: 1587436 - RNA, 19 nt, Homo sapiens
ugaagaaucuguuguuacu

SEQ ID NO: 1587437 - RNA, 19 nt, Homo sapiens
gauuauagaugacggugau

SEQ ID NO: 1587438 - RNA, 19 nt, Homo sapiens
gaaauguaauucucaccau

SEQ ID NO: 1587439 - RNA, 19 nt, Homo sapiens
uaagaagauuggaaaggaa

SEQ ID NO: 1587440 - RNA, 19 nt, Homo sapiens
ucaaagaacucugauaucg

SEQ ID NO: 1587441 - RNA, 19 nt, Homo sapiens
gaaaugaagaguggacuga

SEQ ID NO: 1587442 - RNA, 19 nt, Homo sapiens
gaagaaaguuuugccauug

SEQ ID NO: 1587443 - RNA, 19 nt, Homo sapiens
gaagauugcagaauugcuu

SEQ ID NO: 1587444 - RNA, 19 nt, Homo sapiens
aaagcaaaguggaaccuaa

SEQ ID NO: 1587445 - RNA, 19 nt, Homo sapiens
gggcauuggugauauaaag

SEQ ID NO: 1587446 - RNA, 19 nt, Homo sapiens
ggaagaugcuuuggaugau

SEQ ID NO: 1587447 - RNA, 19 nt, Homo sapiens
ggauaacuaugacuuaagg

SEQ ID NO: 1587448 - RNA, 19 nt, Homo sapiens
gaaaauaaggguucaggua

SEQ ID NO: 1587449 - RNA, 19 nt, Homo sapiens
ggauaacgacuacaaugaa

SEQ ID NO: 1587450 - RNA, 19 nt, Homo sapiens
gaacaagaagaaugcagaa

SEQ ID NO: 1587451 - RNA, 19 nt, Homo sapiens
gaaauuaucugacaaagac

SEQ ID NO: 1587452 - RNA, 19 nt, Homo sapiens
ggagaaguguucauuauug

SEQ ID NO: 1587453 - RNA, 19 nt, Homo sapiens
gagaauuacuggaaaguuu

SEQ ID NO: 1587454 - RNA, 19 nt, Homo sapiens
caagaagaaugcagaaauu

SEQ ID NO: 1587455 - RNA, 19 nt, Homo sapiens
gaagauggauggaauaaac

SEQ ID NO: 1587456 - RNA, 19 nt, Homo sapiens
guaaacagcuuuguacaga

SEQ ID NO: 1587457 - RNA, 19 nt, Homo sapiens
agaaagccguugaauguua

SEQ ID NO: 1587458 - RNA, 19 nt, Homo sapiens
uugcaaagcuguauuauga

SEQ ID NO: 1587459 - RNA, 19 nt, Homo sapiens
gaagaagacgcacacauaa

SEQ ID NO: 1587460 - RNA, 19 nt, Homo sapiens
gcagcggucuuaauucuuu

SEQ ID NO: 1587461 - RNA, 19 nt, Homo sapiens
aaccagagcuugaagauuu

SEQ ID NO: 1587462 - RNA, 19 nt, Homo sapiens
gaauuaaacccaacacaaa

SEQ ID NO: 1587463 - RNA, 19 nt, Homo sapiens
gagccaagaucuccugauu

SEQ ID NO: 1587464 - RNA, 19 nt, Homo sapiens
gaucggaauucuuuacuga

SEQ ID NO: 1587465 - RNA, 19 nt, Homo sapiens
ucccaaagcucacagauuu

SEQ ID NO: 1587466 - RNA, 19 nt, Homo sapiens
gcauagaucucguccuguu

SEQ ID NO: 1587467 - RNA, 19 nt, Homo sapiens
gaaccagacugcagaaugg

SEQ ID NO: 1587468 - RNA, 19 nt, Homo sapiens
aggaauaucuggagucuuu

SEQ ID NO: 1587469 - RNA, 19 nt, Homo sapiens
gaccagggacuaccuaaua

SEQ ID NO: 1587470 - RNA, 19 nt, Homo sapiens
ggaauucauugccugcuuu

SEQ ID NO: 1587471 - RNA, 19 nt, Homo sapiens
gcaggaaaauagagaauua

SEQ ID NO: 1587472 - RNA, 19 nt, Homo sapiens
gccaagaucuccugauuuc

SEQ ID NO: 1587473 - RNA, 19 nt, Homo sapiens
gaauaugauuugccaacaa

SEQ ID NO: 1587474 - RNA, 19 nt, Homo sapiens
ugaagaagacgcacacaua

SEQ ID NO: 1587475 - RNA, 19 nt, Homo sapiens
gaagaacaguauuccugaa

SEQ ID NO: 1587476 - RNA, 19 nt, Homo sapiens
ugaagacucuggacacuga

SEQ ID NO: 1587477 - RNA, 19 nt, Homo sapiens
agaaagaaaugcaggaguu

SEQ ID NO: 1587478 - RNA, 19 nt, Homo sapiens
cgacagaagucaaugaaag

SEQ ID NO: 1587479 - RNA, 19 nt, Homo sapiens
aaacagcuuuguacagaaa

SEQ ID NO: 1587480 - RNA, 19 nt, Homo sapiens
gcaaagcuguauuaugaag

SEQ ID NO: 1587481 - RNA, 19 nt, Homo sapiens
caaaugcgccugaaucaau

SEQ ID NO: 1587482 - RNA, 19 nt, Homo sapiens
gcacauguugcuaagcuua

SEQ ID NO: 1587483 - RNA, 19 nt, Homo sapiens
uacagacccuuaaggaaua

SEQ ID NO: 1587484 - RNA, 19 nt, Homo sapiens
guacagacccuuaaggaau

SEQ ID NO: 1587485 - RNA, 19 nt, Homo sapiens
aggaacagcuucuagauug

SEQ ID NO: 1587486 - RNA, 19 nt, Homo sapiens
gaacugaauaguccuguga

SEQ ID NO: 1587487 - RNA, 19 nt, Homo sapiens
guuccaagaccaaagauua

SEQ ID NO: 1587488 - RNA, 19 nt, Homo sapiens
ggaauuaaacccaacacaa

SEQ ID NO: 1587489 - RNA, 19 nt, Homo sapiens
gaaacuaaauagcaguaag

SEQ ID NO: 1587490 - RNA, 19 nt, Homo sapiens
caaaauaccuucagaaaac

SEQ ID NO: 1587491 - RNA, 19 nt, Homo sapiens
guuauaugaugcucuguuu

SEQ ID NO: 1587492 - RNA, 19 nt, Homo sapiens
gaaguccugcaauuuauaa

SEQ ID NO: 1587493 - RNA, 19 nt, Homo sapiens
acacugaacugacuuugga

SEQ ID NO: 1587494 - RNA, 19 nt, Homo sapiens
gaagaaugcagaaauuauc

SEQ ID NO: 1587495 - RNA, 19 nt, Homo sapiens
agagaaagccguugaaugu

SEQ ID NO: 1587496 - RNA, 19 nt, Homo sapiens
gauuauagaugacggugau

SEQ ID NO: 1587497 - RNA, 19 nt, Homo sapiens
gaaauguaauucucaccau

SEQ ID NO: 1587498 - RNA, 19 nt, Homo sapiens
gaagaaaguuuugccauug

SEQ ID NO: 1587499 - RNA, 19 nt, Homo sapiens
gaagauugcagaauugcuu

SEQ ID NO: 1587500 - RNA, 19 nt, Homo sapiens
gaacaagaagaaugcagaa

SEQ ID NO: 1587501 - RNA, 19 nt, Homo sapiens
ggaagaaaguuuugccauu

SEQ ID NO: 1587502 - RNA, 19 nt, Homo sapiens
aaaugcgccugaaucaaua

SEQ ID NO: 1587503 - RNA, 19 nt, Homo sapiens
acugucagcuacuuucuua

SEQ ID NO: 1587504 - RNA, 19 nt, Homo sapiens
gcuaaucuuaugcuucuua

SEQ ID NO: 1587505 - RNA, 19 nt, Homo sapiens
ggaaguccugcaauuuaua

SEQ ID NO: 1587506 - RNA, 19 nt, Homo sapiens
uagauaagaucaugucaag

SEQ ID NO: 1587507 - RNA, 19 nt, Homo sapiens
caaguauucucccgaaaca

SEQ ID NO: 1587508 - RNA, 19 nt, Homo sapiens
gaaaugcagauucagaaau

SEQ ID NO: 1587509 - RNA, 19 nt, Homo sapiens
gggacuaccuaauaaagau

SEQ ID NO: 1587510 - RNA, 19 nt, Homo sapiens
gcgccugaaucaauaugua

SEQ ID NO: 1587511 - RNA, 19 nt, Homo sapiens
gcacauaaugguagucuuc

SEQ ID NO: 1587512 - RNA, 19 nt, Homo sapiens
gaaggcagaagacauugaa

SEQ ID NO: 1587513 - RNA, 19 nt, Homo sapiens
uugaagauuuggcuagaua

SEQ ID NO: 1587514 - RNA, 19 nt, Homo sapiens
gaaagccguugaauguuac

SEQ ID NO: 1587515 - RNA, 19 nt, Homo sapiens
gggcagcggucuuaauucu

SEQ ID NO: 1587516 - RNA, 19 nt, Homo sapiens
uaccagccacuuacaauua

SEQ ID NO: 1587517 - RNA, 19 nt, Homo sapiens
gaagaugggucagcauggu

SEQ ID NO: 1587518 - RNA, 19 nt, Homo sapiens
ggacagaagaucggaauuc

SEQ ID NO: 1587519 - RNA, 19 nt, Homo sapiens
gagaaguguucauuauugg

SEQ ID NO: 1587520 - RNA, 19 nt, Homo sapiens
uagaggccauuaagaaaga

SEQ ID NO: 1587521 - RNA, 19 nt, Homo sapiens
gaaguguucauuauuggaa

SEQ ID NO: 1587522 - RNA, 19 nt, Homo sapiens
gacaaaaucugcuggaaau

SEQ ID NO: 1587523 - RNA, 19 nt, Homo sapiens
uugcagaauugcuuuguaa

SEQ ID NO: 1587524 - RNA, 19 nt, Homo sapiens
guugaagauugcagaauug

SEQ ID NO: 1587525 - RNA, 19 nt, Homo sapiens
agaagucaaugaaaggauu

SEQ ID NO: 1587526 - RNA, 19 nt, Homo sapiens
caccgucuccuaccaaaua

SEQ ID NO: 1587527 - RNA, 19 nt, Homo sapiens
uauguuggaugcaguaaau

SEQ ID NO: 1587528 - RNA, 19 nt, Homo sapiens
cuauugauccucuguuuaa

SEQ ID NO: 1587529 - RNA, 19 nt, Homo sapiens
gaaaagcaguaccuggaaa

SEQ ID NO: 1587530 - RNA, 19 nt, Homo sapiens
gaguggaauucguguguug

SEQ ID NO: 1587531 - RNA, 19 nt, Homo sapiens
ggaacagcuucuagauugu

SEQ ID NO: 1587532 - RNA, 19 nt, Homo sapiens
gauaagaucaugucaagac

SEQ ID NO: 1587533 - RNA, 19 nt, Homo sapiens
cgaagacuauagugaagga

SEQ ID NO: 1587534 - RNA, 19 nt, Homo sapiens
ugaaguauuucuccuugga

SEQ ID NO: 1587535 - RNA, 19 nt, Homo sapiens
gaagguaaagcuggacaaa

SEQ ID NO: 1587536 - RNA, 19 nt, Homo sapiens
uuucugagcuggcugcauu

SEQ ID NO: 1587537 - RNA, 19 nt, Homo sapiens
uaaaggaacagcuucuaga

SEQ ID NO: 1587538 - RNA, 19 nt, Homo sapiens
gaaagaaaugcaggaguug

SEQ ID NO: 1587539 - RNA, 19 nt, Homo sapiens
gcaguaaauggaaauauag

SEQ ID NO: 1587540 - RNA, 19 nt, Homo sapiens
gaugaacugucagcuacuu

SEQ ID NO: 1587541 - RNA, 19 nt, Homo sapiens
gucagaacuuuauguaaga

SEQ ID NO: 1587542 - RNA, 19 nt, Homo sapiens
caacaaguagaggccauua

SEQ ID NO: 1587543 - RNA, 19 nt, Homo sapiens
ggaaccagacugcagaaug

SEQ ID NO: 1587544 - RNA, 19 nt, Homo sapiens
gcaggaacucgaagacuau

SEQ ID NO: 1587545 - RNA, 19 nt, Homo sapiens
uaaacagcuuuguacagaa

SEQ ID NO: 1587546 - RNA, 19 nt, Homo sapiens
gaauucauugccugcuuua

SEQ ID NO: 1587547 - RNA, 19 nt, Homo sapiens
ugacaaagaccagggacua

SEQ ID NO: 1587548 - RNA, 19 nt, Homo sapiens
gggagaaguguucauuauu

SEQ ID NO: 1587549 - RNA, 19 nt, Homo sapiens
gauacgauguuggugcuau

SEQ ID NO: 1587550 - RNA, 19 nt, Homo sapiens
ucucauagcauuucagguu

SEQ ID NO: 1587551 - RNA, 19 nt, Homo sapiens
gagcauggguguccuagug

SEQ ID NO: 1587552 - RNA, 19 nt, Homo sapiens
gcagguggcuggacugagu

SEQ ID NO: 1587553 - RNA, 19 nt, Homo sapiens
ggacucagcggguauaaag

SEQ ID NO: 1587554 - RNA, 19 nt, Homo sapiens
gagaagucguugagaucuu

SEQ ID NO: 1587555 - RNA, 19 nt, Homo sapiens
ggaaggggcuggcuggauu

SEQ ID NO: 1587556 - RNA, 19 nt, Homo sapiens
gagaugugauccugguguu

SEQ ID NO: 1587557 - RNA, 19 nt, Homo sapiens
gcauggaggccaaggagaa

SEQ ID NO: 1587558 - RNA, 19 nt, Homo sapiens
ggagaagcagcaucuguug

SEQ ID NO: 1587559 - RNA, 19 nt, Homo sapiens
cugcauaucugggcacuga

SEQ ID NO: 1587560 - RNA, 19 nt, Homo sapiens
gagcugccuucauccaugu

SEQ ID NO: 1587561 - RNA, 19 nt, Homo sapiens
caagggcguugacuucaca

SEQ ID NO: 1587562 - RNA, 19 nt, Homo sapiens
gaugugauccugguguuga

SEQ ID NO: 1587563 - RNA, 19 nt, Homo sapiens
cguccgagcugccuucauc

SEQ ID NO: 1587564 - RNA, 19 nt, Homo sapiens
agaagucguugagaucuug

SEQ ID NO: 1587565 - RNA, 19 nt, Homo sapiens
ccauccagaucgaggacua

SEQ ID NO: 1587566 - RNA, 19 nt, Homo sapiens
gcugugaacaucauaaugg

SEQ ID NO: 1587567 - RNA, 19 nt, Homo sapiens
gaccuggccuggacuugca

SEQ ID NO: 1587568 - RNA, 19 nt, Homo sapiens
ggguauaaagcuaguguga

SEQ ID NO: 1587569 - RNA, 19 nt, Homo sapiens
ucacugccaugcucagaag

SEQ ID NO: 1587570 - RNA, 19 nt, Homo sapiens
ggacuacucggaggacaug

SEQ ID NO: 1587571 - RNA, 19 nt, Homo sapiens
caucugcaccuucgucuuc

SEQ ID NO: 1587572 - RNA, 19 nt, Homo sapiens
ccuaguggcagccuauauu

SEQ ID NO: 1587573 - RNA, 19 nt, Homo sapiens
caugugaucggcgacuuua

SEQ ID NO: 1587574 - RNA, 19 nt, Homo sapiens
ggacaaccuugaccauccu

SEQ ID NO: 1587575 - RNA, 19 nt, Homo sapiens
gcagagcauggguguccua

SEQ ID NO: 1587576 - RNA, 19 nt, Homo sapiens
ccaaccagcaggaggagaa

SEQ ID NO: 1587577 - RNA, 19 nt, Homo sapiens
ccaaggagaagcagcaucu

SEQ ID NO: 1587578 - RNA, 19 nt, Homo sapiens
cuaguggcagccuauauuu

SEQ ID NO: 1587579 - RNA, 19 nt, Homo sapiens
gaucggagaagucguugag

SEQ ID NO: 1587580 - RNA, 19 nt, Homo sapiens
gcccuggucucuguacugu

SEQ ID NO: 1587581 - RNA, 19 nt, Homo sapiens
ucggagaagucguugagau

SEQ ID NO: 1587582 - RNA, 19 nt, Homo sapiens
ugggagcccuggucucugu

SEQ ID NO: 1587583 - RNA, 19 nt, Homo sapiens
agaagcagcaucuguugga

SEQ ID NO: 1587584 - RNA, 19 nt, Homo sapiens
gcaccuucgucuucuccau

SEQ ID NO: 1587585 - RNA, 19 nt, Homo sapiens
ggagaagucguugagaucu

SEQ ID NO: 1587586 - RNA, 19 nt, Homo sapiens
caugaucggagaagucguu

SEQ ID NO: 1587587 - RNA, 19 nt, Homo sapiens
ccauugcucagaauacaga

SEQ ID NO: 1587588 - RNA, 19 nt, Homo sapiens
ucaagccagaauacaagua

SEQ ID NO: 1587589 - RNA, 19 nt, Homo sapiens
gcuagugugacccugcaaa

SEQ ID NO: 1587590 - RNA, 19 nt, Homo sapiens
ggucauacacgggaucucu

SEQ ID NO: 1587591 - RNA, 19 nt, Homo sapiens
caucgccauugcucagaau

SEQ ID NO: 1587592 - RNA, 19 nt, Homo sapiens
ggcccagccuguucugucu

SEQ ID NO: 1587593 - RNA, 19 nt, Homo sapiens
cgccauugcucagaauaca

SEQ ID NO: 1587594 - RNA, 19 nt, Homo sapiens
ggacuugcaggccauugag

SEQ ID NO: 1587595 - RNA, 19 nt, Homo sapiens
ccaucugccuguuguucau

SEQ ID NO: 1587596 - RNA, 19 nt, Homo sapiens
aggagaagcagcaucuguu

SEQ ID NO: 1587597 - RNA, 19 nt, Homo sapiens
ugugaucggcgacuuuaug

SEQ ID NO: 1587598 - RNA, 19 nt, Homo sapiens
ccaugugaucggcgacuuu

SEQ ID NO: 1587599 - RNA, 19 nt, Homo sapiens
gcugcgcuguggcugugaa

SEQ ID NO: 1587600 - RNA, 19 nt, Homo sapiens
gcugaucucuggggacuau

SEQ ID NO: 1587601 - RNA, 19 nt, Homo sapiens
gaacaacaaggacaacuuu

SEQ ID NO: 1587602 - RNA, 19 nt, Homo sapiens
ggucucagguccagcuuua

SEQ ID NO: 1587603 - RNA, 19 nt, Homo sapiens
gcugaugaguuaauuguuu

SEQ ID NO: 1587604 - RNA, 19 nt, Homo sapiens
gagcuuagauucuguaugc

SEQ ID NO: 1587605 - RNA, 19 nt, Homo sapiens
ccacagcccuaguaugaaa

SEQ ID NO: 1587606 - RNA, 19 nt, Homo sapiens
gcuauccucuuauuccuuu

SEQ ID NO: 1587607 - RNA, 19 nt, Homo sapiens
ggucugagcugucccaagu

SEQ ID NO: 1587608 - RNA, 19 nt, Homo sapiens
caaagugcaugcaggagaa

SEQ ID NO: 1587609 - RNA, 19 nt, Homo sapiens
ggauugugcugauguagug

SEQ ID NO: 1587610 - RNA, 19 nt, Homo sapiens
ggaggauugugcugaugua

SEQ ID NO: 1587611 - RNA, 19 nt, Homo sapiens
ucgaggagcugucaaagug

SEQ ID NO: 1587612 - RNA, 19 nt, Homo sapiens
gguuggagcuuugcaauuc

SEQ ID NO: 1587613 - RNA, 19 nt, Homo sapiens
caacaaggacaacuuuaug

SEQ ID NO: 1587614 - RNA, 19 nt, Homo sapiens
aauguaugcuauccucuua

SEQ ID NO: 1587615 - RNA, 19 nt, Homo sapiens
guagugaccaagugcaaua

SEQ ID NO: 1587616 - RNA, 19 nt, Homo sapiens
gcucaagucugucuauugc

SEQ ID NO: 1587617 - RNA, 19 nt, Homo sapiens
aggcuuaacucgcugauga

SEQ ID NO: 1587618 - RNA, 19 nt, Homo sapiens
ggacaacuuuauguagaga

SEQ ID NO: 1587619 - RNA, 19 nt, Homo sapiens
gggcagaaccgaccacuca

SEQ ID NO: 1587620 - RNA, 19 nt, Homo sapiens
ggaggaggauugugcugau

SEQ ID NO: 1587621 - RNA, 19 nt, Homo sapiens
acacaagguuggagcuuug

SEQ ID NO: 1587622 - RNA, 19 nt, Homo sapiens
acuacaagcugcacaaugu

SEQ ID NO: 1587623 - RNA, 19 nt, Homo sapiens
gaagagccggcaccuguug

SEQ ID NO: 1587624 - RNA, 19 nt, Homo sapiens
gggcgguccugcacagauu

SEQ ID NO: 1587625 - RNA, 19 nt, Homo sapiens
gaaccgaccacucaucaag

SEQ ID NO: 1587626 - RNA, 19 nt, Homo sapiens
gcaaggcucguuccuguuc

SEQ ID NO: 1587627 - RNA, 19 nt, Homo sapiens
gcccaggccuagcuacuau

SEQ ID NO: 1587628 - RNA, 19 nt, Homo sapiens
gacgacaaccaccaccuua

SEQ ID NO: 1587629 - RNA, 19 nt, Homo sapiens
aaggacaacuuuauguaga

SEQ ID NO: 1587630 - RNA, 19 nt, Homo sapiens
cggaagauguccaacaagu

SEQ ID NO: 1587631 - RNA, 19 nt, Homo sapiens
uaaagugaguacuguuaag

SEQ ID NO: 1587632 - RNA, 19 nt, Homo sapiens
uguaugcuauccucuuauu

SEQ ID NO: 1587633 - RNA, 19 nt, Homo sapiens
gcaccacggccagaaguaa

SEQ ID NO: 1587634 - RNA, 19 nt, Homo sapiens
ggccgaagcugcugugacu

SEQ ID NO: 1587635 - RNA, 19 nt, Homo sapiens
gcacccagccugcuacaca

SEQ ID NO: 1587636 - RNA, 19 nt, Homo sapiens
gaauaaaaccuacacacaa

SEQ ID NO: 1587637 - RNA, 19 nt, Homo sapiens
acaaggacaacuuuaugua

SEQ ID NO: 1587638 - RNA, 19 nt, Homo sapiens
aaaagaaucggcaguauuu

SEQ ID NO: 1587639 - RNA, 19 nt, Homo sapiens
gugaguacuguuaagaaua

SEQ ID NO: 1587640 - RNA, 19 nt, Homo sapiens
gaggcccacucucugugua

SEQ ID NO: 1587641 - RNA, 19 nt, Homo sapiens
ucccacagcccuaguauga

SEQ ID NO: 1587642 - RNA, 19 nt, Homo sapiens
cgacaaccaccaccuuaug

SEQ ID NO: 1587643 - RNA, 19 nt, Homo sapiens
caaggacaacuuuauguag

SEQ ID NO: 1587644 - RNA, 19 nt, Homo sapiens
gcucguuccuguucagaag

SEQ ID NO: 1587645 - RNA, 19 nt, Homo sapiens
cacacaagguuggagcuuu

SEQ ID NO: 1587646 - RNA, 19 nt, Homo sapiens
uggcuucccucucugaaau

SEQ ID NO: 1587647 - RNA, 19 nt, Homo sapiens
ccaagaagagcaagaaagg

SEQ ID NO: 1587648 - RNA, 19 nt, Homo sapiens
uacaagcugcacaauguua

SEQ ID NO: 1587649 - RNA, 19 nt, Homo sapiens
ccuguggccucuacuacaa

SEQ ID NO: 1587650 - RNA, 19 nt, Homo sapiens
ugacggagagcaugaagau

SEQ ID NO: 1587651 - RNA, 19 nt, Homo sapiens
guggacgucuucuucaauc

SEQ ID NO: 1587652 - RNA, 19 nt, Homo sapiens
gugcugauguagugaccaa

SEQ ID NO: 1587653 - RNA, 19 nt, Homo sapiens
caggaaggaaacaacauuu

SEQ ID NO: 1587654 - RNA, 19 nt, Homo sapiens
ggacaguuguuuggagaac

SEQ ID NO: 1587655 - RNA, 19 nt, Homo sapiens
guacuaguguccgcauaag

SEQ ID NO: 1587656 - RNA, 19 nt, Homo sapiens
gaggaggauugugcugaug

SEQ ID NO: 1587657 - RNA, 19 nt, Homo sapiens
acaacaaggacaacuuuau

SEQ ID NO: 1587658 - RNA, 19 nt, Homo sapiens
caacgccuguggccucuac

SEQ ID NO: 1587659 - RNA, 19 nt, Homo sapiens
gcccugcuaugaaaggaau

SEQ ID NO: 1587660 - RNA, 19 nt, Homo sapiens
uccaacaaguccaagaaga

SEQ ID NO: 1587661 - RNA, 19 nt, Homo sapiens
ggaagauguccaacaaguc

SEQ ID NO: 1587662 - RNA, 19 nt, Homo sapiens
acaggccacugaccaugaa

SEQ ID NO: 1587663 - RNA, 19 nt, Homo sapiens
caagaugaaugggcagaac

SEQ ID NO: 1587664 - RNA, 19 nt, Homo sapiens
cagacgaaggcaaccauuu

SEQ ID NO: 1587665 - RNA, 19 nt, Homo sapiens
cgagguggacgucuucuuc

SEQ ID NO: 1587666 - RNA, 19 nt, Homo sapiens
gaaggaagggauccagacu

SEQ ID NO: 1587667 - RNA, 19 nt, Homo sapiens
aaacgugucccgagcuuag

SEQ ID NO: 1587668 - RNA, 19 nt, Homo sapiens
ggaauaaaaccuacacaca

SEQ ID NO: 1587669 - RNA, 19 nt, Homo sapiens
gugagcuggugccugcuuu

SEQ ID NO: 1587670 - RNA, 19 nt, Homo sapiens
gggauuggcggguccacuu

SEQ ID NO: 1587671 - RNA, 19 nt, Homo sapiens
cagaaccgaccacucauca

SEQ ID NO: 1587672 - RNA, 19 nt, Homo sapiens
gcagaaccgaccacucauc

SEQ ID NO: 1587673 - RNA, 19 nt, Homo sapiens
agugaguacuguuaagaau

SEQ ID NO: 1587674 - RNA, 19 nt, Homo sapiens
gugaccaagugcaauaugg

SEQ ID NO: 1587675 - RNA, 19 nt, Homo sapiens
cggagagcaugaagaugga

SEQ ID NO: 1587676 - RNA, 19 nt, Homo sapiens
gagcuggugccugcuuuga

SEQ ID NO: 1587677 - RNA, 19 nt, Homo sapiens
cacucuggcucccaccuuu

SEQ ID NO: 1587678 - RNA, 19 nt, Homo sapiens
aauguuaacaggccacuga

SEQ ID NO: 1587679 - RNA, 19 nt, Homo sapiens
acaggaaggaaacaacauu

SEQ ID NO: 1587680 - RNA, 19 nt, Homo sapiens
cuacagcagcggacucuuc

SEQ ID NO: 1587681 - RNA, 19 nt, Homo sapiens
aaagugaguacuguuaaga

SEQ ID NO: 1587682 - RNA, 19 nt, Homo sapiens
acuaguguccgcauaagaa

SEQ ID NO: 1587683 - RNA, 19 nt, Homo sapiens
ggaucccacagcccuagua

SEQ ID NO: 1587684 - RNA, 19 nt, Homo sapiens
ucacugacggagagcauga

SEQ ID NO: 1587685 - RNA, 19 nt, Homo sapiens
gagagcaugaagauggaaa

SEQ ID NO: 1587686 - RNA, 19 nt, Homo sapiens
ccaacaaguccaagaagag

SEQ ID NO: 1587687 - RNA, 19 nt, Homo sapiens
accggaagauguccaacaa

SEQ ID NO: 1587688 - RNA, 19 nt, Homo sapiens
acaagcugcacaauguuaa

SEQ ID NO: 1587689 - RNA, 19 nt, Homo sapiens
gagguggacgucuucuuca

SEQ ID NO: 1587690 - RNA, 19 nt, Homo sapiens
ccucuuauuccuuuaaagu

SEQ ID NO: 1587691 - RNA, 19 nt, Homo sapiens
ggccuuugcugcccuuggu

SEQ ID NO: 1587692 - RNA, 19 nt, Homo sapiens
ucacaggaaggaaacaaca

SEQ ID NO: 1587693 - RNA, 19 nt, Homo sapiens
ccugcacccucuucucuuc

SEQ ID NO: 1587694 - RNA, 19 nt, Homo sapiens
gacaaccaccaccuuaugg

SEQ ID NO: 1587695 - RNA, 19 nt, Homo sapiens
gagcaccacggccagaagu

SEQ ID NO: 1587696 - RNA, 19 nt, Homo sapiens
gaucccacagcccuaguau

SEQ ID NO: 1587697 - RNA, 19 nt, Homo sapiens
ggauuggcggguccacuug

SEQ ID NO: 1587698 - RNA, 19 nt, Homo sapiens
gcaugcaggagaagucauc

SEQ ID NO: 1587699 - RNA, 19 nt, Homo sapiens
gccacuaccugugcaaugc

SEQ ID NO: 1587700 - RNA, 19 nt, Homo sapiens
auaaacgugucccgagcuu

SEQ ID NO: 1587701 - RNA, 19 nt, Homo sapiens
cagaaagccuuacuuauuu

SEQ ID NO: 1587702 - RNA, 19 nt, Homo sapiens
gcauuaagauggcugguua

SEQ ID NO: 1587703 - RNA, 19 nt, Homo sapiens
ccagaaagccuuacuuauu

SEQ ID NO: 1587704 - RNA, 19 nt, Homo sapiens
gaucagggcaugugcuuua

SEQ ID NO: 1587705 - RNA, 19 nt, Homo sapiens
cacaggagguguucauuaa

SEQ ID NO: 1587706 - RNA, 19 nt, Homo sapiens
gagcaagacuccaucucaa

SEQ ID NO: 1587707 - RNA, 19 nt, Homo sapiens
ccgauucucugcagcuuua

SEQ ID NO: 1587708 - RNA, 19 nt, Homo sapiens
gaagcagacggguguauaa

SEQ ID NO: 1587709 - RNA, 19 nt, Homo sapiens
ggacaaagaggccaucugu

SEQ ID NO: 1587710 - RNA, 19 nt, Homo sapiens
gaccugaccugagaauuga

SEQ ID NO: 1587711 - RNA, 19 nt, Homo sapiens
ugaguuaucugaaaguguu

SEQ ID NO: 1587712 - RNA, 19 nt, Homo sapiens
gcuccaagcugacguaucu

SEQ ID NO: 1587713 - RNA, 19 nt, Homo sapiens
ggaagaagagcaagguuga

SEQ ID NO: 1587714 - RNA, 19 nt, Homo sapiens
aaacaacucuggugggaau

SEQ ID NO: 1587715 - RNA, 19 nt, Homo sapiens
ccacaggagguguucauua

SEQ ID NO: 1587716 - RNA, 19 nt, Homo sapiens
gaagagcuguauccugaca

SEQ ID NO: 1587717 - RNA, 19 nt, Homo sapiens
gaacgaggaggaagaugaa

SEQ ID NO: 1587718 - RNA, 19 nt, Homo sapiens
aagaaauacuggaagcaua

SEQ ID NO: 1587719 - RNA, 19 nt, Homo sapiens
gcccagaaagccuuacuua

SEQ ID NO: 1587720 - RNA, 19 nt, Homo sapiens
ccagauaauucgccagaug

SEQ ID NO: 1587721 - RNA, 19 nt, Homo sapiens
caacaugguccagauaauu

SEQ ID NO: 1587722 - RNA, 19 nt, Homo sapiens
ggacgaggaggaagaagaa

SEQ ID NO: 1587723 - RNA, 19 nt, Homo sapiens
caaggccuauaaucaguaa

SEQ ID NO: 1587724 - RNA, 19 nt, Homo sapiens
ugacccagcuguggaguaa

SEQ ID NO: 1587725 - RNA, 19 nt, Homo sapiens
ggaaauaaaguuggaaaca

SEQ ID NO: 1587726 - RNA, 19 nt, Homo sapiens
cuaccgagaagaagaaaua

SEQ ID NO: 1587727 - RNA, 19 nt, Homo sapiens
gggacaacguagacuauau

SEQ ID NO: 1587728 - RNA, 19 nt, Homo sapiens
agaccaagaugacgaugaa

SEQ ID NO: 1587729 - RNA, 19 nt, Homo sapiens
ggaagcagacggguguaua

SEQ ID NO: 1587730 - RNA, 19 nt, Homo sapiens
gcaggaguaccaggaaaua

SEQ ID NO: 1587731 - RNA, 19 nt, Homo sapiens
ggacaacguagacuauaug

SEQ ID NO: 1587732 - RNA, 19 nt, Homo sapiens
gugaaaccuugcauucuga

SEQ ID NO: 1587733 - RNA, 19 nt, Homo sapiens
gcagugacaccaugccaaa

SEQ ID NO: 1587734 - RNA, 19 nt, Homo sapiens
ucugugagguggacaaaga

SEQ ID NO: 1587735 - RNA, 19 nt, Homo sapiens
gcaaggccuauaaucagua

SEQ ID NO: 1587736 - RNA, 19 nt, Homo sapiens
acaaagaggccaucugugu

SEQ ID NO: 1587737 - RNA, 19 nt, Homo sapiens
ccacccagcugccaccaau

SEQ ID NO: 1587738 - RNA, 19 nt, Homo sapiens
acagugguauaacuaauug

SEQ ID NO: 1587739 - RNA, 19 nt, Homo sapiens
acgaagaguuguuccaaga

SEQ ID NO: 1587740 - RNA, 19 nt, Homo sapiens
gcaggagaaugacaugaac

SEQ ID NO: 1587741 - RNA, 19 nt, Homo sapiens
ucugcaagcuagaaucaaa

SEQ ID NO: 1587742 - RNA, 19 nt, Homo sapiens
cuugagaccugaccugaga

SEQ ID NO: 1587743 - RNA, 19 nt, Homo sapiens
ugagugcugccacaaauaa

SEQ ID NO: 1587744 - RNA, 19 nt, Homo sapiens
gaccaagggcaccauuaaa

SEQ ID NO: 1587745 - RNA, 19 nt, Homo sapiens
gaagaaauacuggaagcau

SEQ ID NO: 1587746 - RNA, 19 nt, Homo sapiens
ucaggacuauuaccuagga

SEQ ID NO: 1587747 - RNA, 19 nt, Homo sapiens
ugaccaagggcaccauuaa

SEQ ID NO: 1587748 - RNA, 19 nt, Homo sapiens
gacagugguauaacuaauu

SEQ ID NO: 1587749 - RNA, 19 nt, Homo sapiens
ugaguuagaguucgucuug

SEQ ID NO: 1587750 - RNA, 19 nt, Homo sapiens
ugaggucaauguucuuuua

SEQ ID NO: 1587751 - RNA, 19 nt, Homo sapiens
uaagaugugugaaaaguug

SEQ ID NO: 1587752 - RNA, 19 nt, Homo sapiens
gaaaccggaguaaugauca

SEQ ID NO: 1587753 - RNA, 19 nt, Homo sapiens
ggaaaccggaguaaugauc

SEQ ID NO: 1587754 - RNA, 19 nt, Homo sapiens
ggaaugcugacgaagaguu

SEQ ID NO: 1587755 - RNA, 19 nt, Homo sapiens
caagcuagaaucaaagaau

SEQ ID NO: 1587756 - RNA, 19 nt, Homo sapiens
ugacagugguauaacuaau

SEQ ID NO: 1587757 - RNA, 19 nt, Homo sapiens
ugugaaaccuugcauucug

SEQ ID NO: 1587758 - RNA, 19 nt, Homo sapiens
gagguguucauuaaggaua

SEQ ID NO: 1587759 - RNA, 19 nt, Homo sapiens
aagaaagcauucacagcaa

SEQ ID NO: 1587760 - RNA, 19 nt, Homo sapiens
gggaauacuucagauagag

SEQ ID NO: 1587761 - RNA, 19 nt, Homo sapiens
ccaacaugguccagauaau

SEQ ID NO: 1587762 - RNA, 19 nt, Homo sapiens
ugaaaguguugggcaguga

SEQ ID NO: 1587763 - RNA, 19 nt, Homo sapiens
cagaagauagggucaacuu

SEQ ID NO: 1587764 - RNA, 19 nt, Homo sapiens
gauagagcaagaaagcauu

SEQ ID NO: 1587765 - RNA, 19 nt, Homo sapiens
cccugaaacucuucuguga

SEQ ID NO: 1587766 - RNA, 19 nt, Homo sapiens
ggugacagugguauaacua

SEQ ID NO: 1587767 - RNA, 19 nt, Homo sapiens
caggacaguuuuauuguuu

SEQ ID NO: 1587768 - RNA, 19 nt, Homo sapiens
ggugggaauacuucagaua

SEQ ID NO: 1587769 - RNA, 19 nt, Homo sapiens
gugcaggaguaccaggaaa

SEQ ID NO: 1587770 - RNA, 19 nt, Homo sapiens
gccaacaugguccagauaa

SEQ ID NO: 1587771 - RNA, 19 nt, Homo sapiens
cagcuuucgucccaacuug

SEQ ID NO: 1587772 - RNA, 19 nt, Homo sapiens
agaccugaccugagaauug

SEQ ID NO: 1587773 - RNA, 19 nt, Homo sapiens
ggaggcggagcuugcagua

SEQ ID NO: 1587774 - RNA, 19 nt, Homo sapiens
caucaucaguacuccuugu

SEQ ID NO: 1587775 - RNA, 19 nt, Homo sapiens
ggaggaggaggacgaggaa

SEQ ID NO: 1587776 - RNA, 19 nt, Homo sapiens
ccuauaaucaguaagaugu

SEQ ID NO: 1587777 - RNA, 19 nt, Homo sapiens
caggagguguucauuaagg

SEQ ID NO: 1587778 - RNA, 19 nt, Homo sapiens
gagcaagaaagcauucaca

SEQ ID NO: 1587779 - RNA, 19 nt, Homo sapiens
ugggaauacuucagauaga

SEQ ID NO: 1587780 - RNA, 19 nt, Homo sapiens
gaaugcugacgaagaguug

SEQ ID NO: 1587781 - RNA, 19 nt, Homo sapiens
ucugcagucuuaacucuga

SEQ ID NO: 1587782 - RNA, 19 nt, Homo sapiens
ucugagugcugccacaaau

SEQ ID NO: 1587783 - RNA, 19 nt, Homo sapiens
caucaguacuccuuguuuu

SEQ ID NO: 1587784 - RNA, 19 nt, Homo sapiens
auuaaauggugucagguuu

SEQ ID NO: 1587785 - RNA, 19 nt, Homo sapiens
ggaguaccaggaaauaaag

SEQ ID NO: 1587786 - RNA, 19 nt, Homo sapiens
ggcaggagaaugacaugaa

SEQ ID NO: 1587787 - RNA, 19 nt, Homo sapiens
auaacuggaugccuggauu

SEQ ID NO: 1587788 - RNA, 19 nt, Homo sapiens
guaccaggaaauaaaguug

SEQ ID NO: 1587789 - RNA, 19 nt, Homo sapiens
agaagaagaaauacuggaa

SEQ ID NO: 1587790 - RNA, 19 nt, Homo sapiens
gcaagacuccaucucaaaa

SEQ ID NO: 1587791 - RNA, 19 nt, Homo sapiens
gcagacccuucaggaggaa

SEQ ID NO: 1587792 - RNA, 19 nt, Homo sapiens
gaguuagaguucgucuuga

SEQ ID NO: 1587793 - RNA, 19 nt, Homo sapiens
ggacaguuuuauuguuuug

SEQ ID NO: 1587794 - RNA, 19 nt, Homo sapiens
acagcaaggccuauaauca

SEQ ID NO: 1587795 - RNA, 19 nt, Homo sapiens
caauagagcaagacuccau

SEQ ID NO: 1587796 - RNA, 19 nt, Homo sapiens
aggcggagcuugcaguaag

SEQ ID NO: 1587797 - RNA, 19 nt, Homo sapiens
gaauuucuucaucuacuuc

SEQ ID NO: 1587798 - RNA, 19 nt, Homo sapiens
ccagagagaggcugugagu

SEQ ID NO: 1587799 - RNA, 19 nt, Homo sapiens
ucaguaagaugugugaaaa

SEQ ID NO: 1587800 - RNA, 19 nt, Homo sapiens
agaacgaggaggaagauga

SEQ ID NO: 1587801 - RNA, 19 nt, Homo sapiens
gagcagagcuuaacucauu

SEQ ID NO: 1587802 - RNA, 19 nt, Homo sapiens
agacaucacuggcaacuua

SEQ ID NO: 1587803 - RNA, 19 nt, Homo sapiens
gagcuuagaggcaaaguua

SEQ ID NO: 1587804 - RNA, 19 nt, Homo sapiens
aaacugcccucuaauaaga

SEQ ID NO: 1587805 - RNA, 19 nt, Homo sapiens
ggaagucacagaacaguaa

SEQ ID NO: 1587806 - RNA, 19 nt, Homo sapiens
aaucaaggaucacaaacua

SEQ ID NO: 1587807 - RNA, 19 nt, Homo sapiens
ggaauguccuucucaaugg

SEQ ID NO: 1587808 - RNA, 19 nt, Homo sapiens
ccacaggccuggucacaug

SEQ ID NO: 1587809 - RNA, 19 nt, Homo sapiens
uuaagagacucaucagauu

SEQ ID NO: 1587810 - RNA, 19 nt, Homo sapiens
ggaaugaaaguguuaggaa

SEQ ID NO: 1587811 - RNA, 19 nt, Homo sapiens
caacuugacaucaugcuuu

SEQ ID NO: 1587812 - RNA, 19 nt, Homo sapiens
gagaccaaaugcaggauga

SEQ ID NO: 1587813 - RNA, 19 nt, Homo sapiens
ggacugggacguagcaaug

SEQ ID NO: 1587814 - RNA, 19 nt, Homo sapiens
gagaaaagcaucugcaaaa

SEQ ID NO: 1587815 - RNA, 19 nt, Homo sapiens
cagaagacaggaagcauuu

SEQ ID NO: 1587816 - RNA, 19 nt, Homo sapiens
ccagccagauguugucauu

SEQ ID NO: 1587817 - RNA, 19 nt, Homo sapiens
gggaauguccuucucaaug

SEQ ID NO: 1587818 - RNA, 19 nt, Homo sapiens
aaucaaaacugcccucuaa

SEQ ID NO: 1587819 - RNA, 19 nt, Homo sapiens
cagccuguguuuguaaaua

SEQ ID NO: 1587820 - RNA, 19 nt, Homo sapiens
gaagacaggaagcauuuca

SEQ ID NO: 1587821 - RNA, 19 nt, Homo sapiens
gaacccggcagccuucauu

SEQ ID NO: 1587822 - RNA, 19 nt, Homo sapiens
agacaggaaugaaaguguu

SEQ ID NO: 1587823 - RNA, 19 nt, Homo sapiens
gagggaauguccuucucaa

SEQ ID NO: 1587824 - RNA, 19 nt, Homo sapiens
ucacaggccuugccaucug

SEQ ID NO: 1587825 - RNA, 19 nt, Homo sapiens
gaacagaagacaggaagca

SEQ ID NO: 1587826 - RNA, 19 nt, Homo sapiens
caaaacugcccucuaauaa

SEQ ID NO: 1587827 - RNA, 19 nt, Homo sapiens
caucccaggucaccacuug

SEQ ID NO: 1587828 - RNA, 19 nt, Homo sapiens
uagcuugccugcaggauca

SEQ ID NO: 1587829 - RNA, 19 nt, Homo sapiens
gaacaguaauacgcuagca

SEQ ID NO: 1587830 - RNA, 19 nt, Homo sapiens
guuaagagacucaucagau

SEQ ID NO: 1587831 - RNA, 19 nt, Homo sapiens
gaagaacagaagacaggaa

SEQ ID NO: 1587832 - RNA, 19 nt, Homo sapiens
gacaggaaugaaaguguua

SEQ ID NO: 1587833 - RNA, 19 nt, Homo sapiens
uggaauguuuggagauuau

SEQ ID NO: 1587834 - RNA, 19 nt, Homo sapiens
acacucgguuccucagaaa

SEQ ID NO: 1587835 - RNA, 19 nt, Homo sapiens
cagaaaaguuugagaaaag

SEQ ID NO: 1587836 - RNA, 19 nt, Homo sapiens
ucacagggaagucacagaa

SEQ ID NO: 1587837 - RNA, 19 nt, Homo sapiens
caaguaugccuggugcuuu

SEQ ID NO: 1587838 - RNA, 19 nt, Homo sapiens
acagggaagucacagaaca

SEQ ID NO: 1587839 - RNA, 19 nt, Homo sapiens
gaggcaaaguuaagagacu

SEQ ID NO: 1587840 - RNA, 19 nt, Homo sapiens
ucaaaacugcccucuaaua

SEQ ID NO: 1587841 - RNA, 19 nt, Homo sapiens
caagagcacagccaucauc

SEQ ID NO: 1587842 - RNA, 19 nt, Homo sapiens
gacaucaugcuuucuggaa

SEQ ID NO: 1587843 - RNA, 19 nt, Homo sapiens
gaaucaaggaucacaaacu

SEQ ID NO: 1587844 - RNA, 19 nt, Homo sapiens
uaagagacucaucagauuc

SEQ ID NO: 1587845 - RNA, 19 nt, Homo sapiens
ucaaggaucacaaacuaca

SEQ ID NO: 1587846 - RNA, 19 nt, Homo sapiens
gcgcuccaccuccaacuug

SEQ ID NO: 1587847 - RNA, 19 nt, Homo sapiens
gucccuaacucccucacuu

SEQ ID NO: 1587848 - RNA, 19 nt, Homo sapiens
cacacucgguuccucagaa

SEQ ID NO: 1587849 - RNA, 19 nt, Homo sapiens
aaaguuaagagacucauca

SEQ ID NO: 1587850 - RNA, 19 nt, Homo sapiens
agccuguguuuguaaauaa

SEQ ID NO: 1587851 - RNA, 19 nt, Homo sapiens
ggacuugagacccuucaca

SEQ ID NO: 1587852 - RNA, 19 nt, Homo sapiens
ggacuugagacccuucaca

SEQ ID NO: 1587853 - RNA, 19 nt, Homo sapiens
gccuguguuuguaaauaaa

SEQ ID NO: 1587854 - RNA, 19 nt, Homo sapiens
gaucagaaaaguuugagaa

SEQ ID NO: 1587855 - RNA, 19 nt, Homo sapiens
gggaagucacagaacagua

SEQ ID NO: 1587856 - RNA, 19 nt, Homo sapiens
cuggaauguuuggagauua

SEQ ID NO: 1587857 - RNA, 19 nt, Homo sapiens
ccuccaacuugacaucaug

SEQ ID NO: 1587858 - RNA, 19 nt, Homo sapiens
acagaagacaggaagcauu

SEQ ID NO: 1587859 - RNA, 19 nt, Homo sapiens
gaagucacagaacaguaau

SEQ ID NO: 1587860 - RNA, 19 nt, Homo sapiens
agacaggaagcauuucaga

SEQ ID NO: 1587861 - RNA, 19 nt, Homo sapiens
aaaugcaggaugaggagua

SEQ ID NO: 1587862 - RNA, 19 nt, Homo sapiens
guuaggaacacggcagaaa

SEQ ID NO: 1587863 - RNA, 19 nt, Homo sapiens
ugaggcauccugugugugu

SEQ ID NO: 1587864 - RNA, 19 nt, Homo sapiens
gacuugagacccuucacaa

SEQ ID NO: 1587865 - RNA, 19 nt, Homo sapiens
aaguaugccuggugcuuuc

SEQ ID NO: 1587866 - RNA, 19 nt, Homo sapiens
gacuugagacccuucacaa

SEQ ID NO: 1587867 - RNA, 19 nt, Homo sapiens
gcccugagacuccaagaag

SEQ ID NO: 1587868 - RNA, 19 nt, Homo sapiens
gcgcggugaccagagcuua

SEQ ID NO: 1587869 - RNA, 19 nt, Homo sapiens
gcacuuggagauggcaaug

SEQ ID NO: 1587870 - RNA, 19 nt, Homo sapiens
ccggcagccuucauuaaca

SEQ ID NO: 1587871 - RNA, 19 nt, Homo sapiens
ucucucagaacucaucaaa

SEQ ID NO: 1587872 - RNA, 19 nt, Homo sapiens
ugugaggcauccugugugu

SEQ ID NO: 1587873 - RNA, 19 nt, Homo sapiens
gcaugaagaacagaagaca

SEQ ID NO: 1587874 - RNA, 19 nt, Homo sapiens
gggcaugaagaacagaaga

SEQ ID NO: 1587875 - RNA, 19 nt, Homo sapiens
acuggaauguuuggagauu

SEQ ID NO: 1587876 - RNA, 19 nt, Homo sapiens
gcagaggucacagggaagu

SEQ ID NO: 1587877 - RNA, 19 nt, Homo sapiens
caagacaggaaugaaagug

SEQ ID NO: 1587878 - RNA, 19 nt, Homo sapiens
cagcugggacugggacgua

SEQ ID NO: 1587879 - RNA, 19 nt, Homo sapiens
ccucuaccuugcagaaugg

SEQ ID NO: 1587880 - RNA, 19 nt, Homo sapiens
ggaauguuuggagauuauu

SEQ ID NO: 1587881 - RNA, 19 nt, Homo sapiens
cagcuucccgggucauuca

SEQ ID NO: 1587882 - RNA, 19 nt, Homo sapiens
cugaaucaaggaucacaaa

SEQ ID NO: 1587883 - RNA, 19 nt, Homo sapiens
caaagaaaguccuuagaua

SEQ ID NO: 1587884 - RNA, 19 nt, Homo sapiens
gaaaguugauuugaaguga

SEQ ID NO: 1587885 - RNA, 19 nt, Homo sapiens
ugauagaccugucauugua

SEQ ID NO: 1587886 - RNA, 19 nt, Homo sapiens
gaaaguccuuagauaaaga

SEQ ID NO: 1587887 - RNA, 19 nt, Homo sapiens
agaaagggaucaugaacua

SEQ ID NO: 1587888 - RNA, 19 nt, Homo sapiens
gaaagaggaaaguugauuu

SEQ ID NO: 1587889 - RNA, 19 nt, Homo sapiens
gugcagaacuaccaccuuu

SEQ ID NO: 1587890 - RNA, 19 nt, Homo sapiens
gaucuaauguaccugauuc

SEQ ID NO: 1587891 - RNA, 19 nt, Homo sapiens
gaggaaaguugauuugaag

SEQ ID NO: 1587892 - RNA, 19 nt, Homo sapiens
auacggagauguuaauuug

SEQ ID NO: 1587893 - RNA, 19 nt, Homo sapiens
ccaaacuacugcuuuaaug

SEQ ID NO: 1587894 - RNA, 19 nt, Homo sapiens
gaagugaggauuagaagug

SEQ ID NO: 1587895 - RNA, 19 nt, Homo sapiens
gcaagcaacuggauugaac

SEQ ID NO: 1587896 - RNA, 19 nt, Homo sapiens
gauuagaagugaaugacaa

SEQ ID NO: 1587897 - RNA, 19 nt, Homo sapiens
gcaaagaaaguccuuagau

SEQ ID NO: 1587898 - RNA, 19 nt, Homo sapiens
uacaagaugugauucauga

SEQ ID NO: 1587899 - RNA, 19 nt, Homo sapiens
guaaaguguucugucauuu

SEQ ID NO: 1587900 - RNA, 19 nt, Homo sapiens
cagaagccguucauuagaa

SEQ ID NO: 1587901 - RNA, 19 nt, Homo sapiens
caagaaagaggaaaguuga

SEQ ID NO: 1587902 - RNA, 19 nt, Homo sapiens
gcaccaaucccaacaugaa

SEQ ID NO: 1587903 - RNA, 19 nt, Homo sapiens
ucacauggugcuuauaaua

SEQ ID NO: 1587904 - RNA, 19 nt, Homo sapiens
ccacaagaccuauuaacaa

SEQ ID NO: 1587905 - RNA, 19 nt, Homo sapiens
gcacuaucauuaaucuuuc

SEQ ID NO: 1587906 - RNA, 19 nt, Homo sapiens
ucacaaauaugagccaaga

SEQ ID NO: 1587907 - RNA, 19 nt, Homo sapiens
ugaaccaucuaauccuaua

SEQ ID NO: 1587908 - RNA, 19 nt, Homo sapiens
ggucaacccuaccuuagug

SEQ ID NO: 1587909 - RNA, 19 nt, Homo sapiens
caccagaagccguucauua

SEQ ID NO: 1587910 - RNA, 19 nt, Homo sapiens
gaaccaagacuggcacuau

SEQ ID NO: 1587911 - RNA, 19 nt, Homo sapiens
uuacuacccuuccaaaugu

SEQ ID NO: 1587912 - RNA, 19 nt, Homo sapiens
ggagacaucagaaagaaug

SEQ ID NO: 1587913 - RNA, 19 nt, Homo sapiens
ggauugaacacccuaagaa

SEQ ID NO: 1587914 - RNA, 19 nt, Homo sapiens
uaacacaagcucuucugua

SEQ ID NO: 1587915 - RNA, 19 nt, Homo sapiens
acugcaagguugacauuua

SEQ ID NO: 1587916 - RNA, 19 nt, Homo sapiens
ugacaaaacccuuuagaua

SEQ ID NO: 1587917 - RNA, 19 nt, Homo sapiens
cuacagagauagccuacug

SEQ ID NO: 1587918 - RNA, 19 nt, Homo sapiens
ggucugggguucaaaauaa

SEQ ID NO: 1587919 - RNA, 19 nt, Homo sapiens
agaggaaaguugauuugaa

SEQ ID NO: 1587920 - RNA, 19 nt, Homo sapiens
gacaaaacccuuuagauaa

SEQ ID NO: 1587921 - RNA, 19 nt, Homo sapiens
uguaaaguguucugucauu

SEQ ID NO: 1587922 - RNA, 19 nt, Homo sapiens
caacccaaauuccaucugu

SEQ ID NO: 1587923 - RNA, 19 nt, Homo sapiens
ugaagaaucuacuaaacag

SEQ ID NO: 1587924 - RNA, 19 nt, Homo sapiens
caggagacaucagaaagaa

SEQ ID NO: 1587925 - RNA, 19 nt, Homo sapiens
cacaagaccuauuaacaag

SEQ ID NO: 1587926 - RNA, 19 nt, Homo sapiens
gcaccugacacuucugaaa

SEQ ID NO: 1587927 - RNA, 19 nt, Homo sapiens
gcaagguugacauuuauug

SEQ ID NO: 1587928 - RNA, 19 nt, Homo sapiens
ugucaaguuugcagaauug

SEQ ID NO: 1587929 - RNA, 19 nt, Homo sapiens
guucacauggugcuuauaa

SEQ ID NO: 1587930 - RNA, 19 nt, Homo sapiens
acaaauaugagccaagaaa

SEQ ID NO: 1587931 - RNA, 19 nt, Homo sapiens
guuguaaaguguucuguca

SEQ ID NO: 1587932 - RNA, 19 nt, Homo sapiens
uuacuucggucacuacuca

SEQ ID NO: 1587933 - RNA, 19 nt, Homo sapiens
gaccacagcugccccaauu

SEQ ID NO: 1587934 - RNA, 19 nt, Homo sapiens
caaauuccaucugugacuu

SEQ ID NO: 1587935 - RNA, 19 nt, Homo sapiens
caccuaaacauccagauaa

SEQ ID NO: 1587936 - RNA, 19 nt, Homo sapiens
gauguuaauuugggauaug

SEQ ID NO: 1587937 - RNA, 19 nt, Homo sapiens
ccaagaaagaggaaaguug

SEQ ID NO: 1587938 - RNA, 19 nt, Homo sapiens
guccuuagauaaagagaga

SEQ ID NO: 1587939 - RNA, 19 nt, Homo sapiens
gagaaaauguuaacacaag

SEQ ID NO: 1587940 - RNA, 19 nt, Homo sapiens
cagaaggcaucaucaccaa

SEQ ID NO: 1587941 - RNA, 19 nt, Homo sapiens
uuuaaaccaugccaaacua

SEQ ID NO: 1587942 - RNA, 19 nt, Homo sapiens
ugacauuuauuguguugug

SEQ ID NO: 1587943 - RNA, 19 nt, Homo sapiens
ccaccuaaacauccagaua

SEQ ID NO: 1587944 - RNA, 19 nt, Homo sapiens
cuauaaaugucugcacaaa

SEQ ID NO: 1587945 - RNA, 19 nt, Homo sapiens
gaaggcaucaucaccaauc

SEQ ID NO: 1587946 - RNA, 19 nt, Homo sapiens
cccaucagcuuccaccaaa

SEQ ID NO: 1587947 - RNA, 19 nt, Homo sapiens
agaagccguucauuagaaa

SEQ ID NO: 1587948 - RNA, 19 nt, Homo sapiens
ggaaaguugauuugaagug

SEQ ID NO: 1587949 - RNA, 19 nt, Homo sapiens
ccugaaccaucuaauccua

SEQ ID NO: 1587950 - RNA, 19 nt, Homo sapiens
gaucaugaacuacgucaca

SEQ ID NO: 1587951 - RNA, 19 nt, Homo sapiens
aaccaagacuggcacuauu

SEQ ID NO: 1587952 - RNA, 19 nt, Homo sapiens
gccaucaaccauuuacuuu

SEQ ID NO: 1587953 - RNA, 19 nt, Homo sapiens
cugcaagguugacauuuau

SEQ ID NO: 1587954 - RNA, 19 nt, Homo sapiens
gaacucuccagaugaacaa

SEQ ID NO: 1587955 - RNA, 19 nt, Homo sapiens
caagaccuauuaacaagac

SEQ ID NO: 1587956 - RNA, 19 nt, Homo sapiens
aacacaagcucuucuguag

SEQ ID NO: 1587957 - RNA, 19 nt, Homo sapiens
ccagaaugccaccaccaua

SEQ ID NO: 1587958 - RNA, 19 nt, Homo sapiens
caucaccaaucacccaaau

SEQ ID NO: 1587959 - RNA, 19 nt, Homo sapiens
gaacuaccaccuuucuuuu

SEQ ID NO: 1587960 - RNA, 19 nt, Homo sapiens
gagauguuaauuugggaua

SEQ ID NO: 1587961 - RNA, 19 nt, Homo sapiens
gauuugaagugaggauuag

SEQ ID NO: 1587962 - RNA, 19 nt, Homo sapiens
agaaaguccuuagauaaag

SEQ ID NO: 1587963 - RNA, 19 nt, Homo sapiens
aacccugacuuuaguugua

SEQ ID NO: 1587964 - RNA, 19 nt, Homo sapiens
caaacuacugcuuuaaugu

SEQ ID NO: 1587965 - RNA, 19 nt, Homo sapiens
gaagugaaugacaauaaag

SEQ ID NO: 1587966 - RNA, 19 nt, Homo sapiens
aaaguguucugucauuuac

SEQ ID NO: 1587967 - RNA, 19 nt, Homo sapiens
gaagaaucuacuaaacaga

SEQ ID NO: 1587968 - RNA, 19 nt, Homo sapiens
cagaaugccaccaccauau

SEQ ID NO: 1587969 - RNA, 19 nt, Homo sapiens
ccagaagccguucauuaga

SEQ ID NO: 1587970 - RNA, 19 nt, Homo sapiens
uguguugugucuaaguuaa

SEQ ID NO: 1587971 - RNA, 19 nt, Homo sapiens
guugacauuuauuguguug

SEQ ID NO: 1587972 - RNA, 19 nt, Homo sapiens
gaaccaucuaauccuauaa

SEQ ID NO: 1587973 - RNA, 19 nt, Homo sapiens
cagaauuauugacgacaug

SEQ ID NO: 1587974 - RNA, 19 nt, Homo sapiens
ugaacacccuaagaagaaa

SEQ ID NO: 1587975 - RNA, 19 nt, Homo sapiens
gaaaguccuauaaaugucu

SEQ ID NO: 1587976 - RNA, 19 nt, Homo sapiens
augccaaacuacugcuuua

SEQ ID NO: 1587977 - RNA, 19 nt, Homo sapiens
ccaggagacaucagaaaga

SEQ ID NO: 1587978 - RNA, 19 nt, Homo sapiens
aaagaggaaaguugauuug

SEQ ID NO: 1587979 - RNA, 19 nt, Homo sapiens
aaauaugagccaagaaaga

SEQ ID NO: 1587980 - RNA, 19 nt, Homo sapiens
auucaugagugcagaacua

SEQ ID NO: 1587981 - RNA, 19 nt, Homo sapiens
gacaucagaaagaaugaaa

SEQ ID NO: 1587982 - RNA, 19 nt, Homo sapiens
auaaaugucugcacaaacg

SEQ ID NO: 1587983 - RNA, 19 nt, Homo sapiens
ggacguagcccaagguauu

SEQ ID NO: 1587984 - RNA, 19 nt, Homo sapiens
cagggaagcuccauaaaug

SEQ ID NO: 1587985 - RNA, 19 nt, Homo sapiens
gguauucucuccuauggaa

SEQ ID NO: 1587986 - RNA, 19 nt, Homo sapiens
gagcggacccagcaguuua

SEQ ID NO: 1587987 - RNA, 19 nt, Homo sapiens
cagcagagccacugagauu

SEQ ID NO: 1587988 - RNA, 19 nt, Homo sapiens
gcagagccacugagauuug

SEQ ID NO: 1587989 - RNA, 19 nt, Homo sapiens
gaacuucuccaacgacauc

SEQ ID NO: 1587990 - RNA, 19 nt, Homo sapiens
gcaggacuguaauaaaugg

SEQ ID NO: 1587991 - RNA, 19 nt, Homo sapiens
gggcagccuuccugagaaa

SEQ ID NO: 1587992 - RNA, 19 nt, Homo sapiens
ggauaaagagaacaaugaa

SEQ ID NO: 1587993 - RNA, 19 nt, Homo sapiens
caaccacacugcaggaagu

SEQ ID NO: 1587994 - RNA, 19 nt, Homo sapiens
ucaaugagcacuuuagcaa

SEQ ID NO: 1587995 - RNA, 19 nt, Homo sapiens
uugcaggacuguaauaaau

SEQ ID NO: 1587996 - RNA, 19 nt, Homo sapiens
ccuauaauccuaagaacuu

SEQ ID NO: 1587997 - RNA, 19 nt, Homo sapiens
caaugaagcgccucuaaca

SEQ ID NO: 1587998 - RNA, 19 nt, Homo sapiens
caagagaagagucggaaga

SEQ ID NO: 1587999 - RNA, 19 nt, Homo sapiens
cauccagccuauaauccua

SEQ ID NO: 1588000 - RNA, 19 nt, Homo sapiens
ccagggaagcuccauaaau

SEQ ID NO: 1588001 - RNA, 19 nt, Homo sapiens
aaauggaucucugguguag

SEQ ID NO: 1588002 - RNA, 19 nt, Homo sapiens
cccaagguauucucuccua

SEQ ID NO: 1588003 - RNA, 19 nt, Homo sapiens
uaaauggaucucuggugua

SEQ ID NO: 1588004 - RNA, 19 nt, Homo sapiens
gaacaaugaagcgccucua

SEQ ID NO: 1588005 - RNA, 19 nt, Homo sapiens
gcagcaaggcccaggugaa

SEQ ID NO: 1588006 - RNA, 19 nt, Homo sapiens
uacugcagcuggagagaaa

SEQ ID NO: 1588007 - RNA, 19 nt, Homo sapiens
uggauaaagagaacaauga

SEQ ID NO: 1588008 - RNA, 19 nt, Homo sapiens
auggaucucugguguagaa

SEQ ID NO: 1588009 - RNA, 19 nt, Homo sapiens
caucaaggucucacacuuc

SEQ ID NO: 1588010 - RNA, 19 nt, Homo sapiens
ccaagguauucucuccuau

SEQ ID NO: 1588011 - RNA, 19 nt, Homo sapiens
ggagcggacccagcaguuu

SEQ ID NO: 1588012 - RNA, 19 nt, Homo sapiens
cauggccuuuguucaguuu

SEQ ID NO: 1588013 - RNA, 19 nt, Homo sapiens
ucucuccuauggaaacaaa

SEQ ID NO: 1588014 - RNA, 19 nt, Homo sapiens
caagguauucucuccuaug

SEQ ID NO: 1588015 - RNA, 19 nt, Homo sapiens
ggaagcuccauaaauguca

SEQ ID NO: 1588016 - RNA, 19 nt, Homo sapiens
agaagacacagaccgguuu

SEQ ID NO: 1588017 - RNA, 19 nt, Homo sapiens
gcaguuuaucccugugaaa

SEQ ID NO: 1588018 - RNA, 19 nt, Homo sapiens
ucuaacagcaggcaugaga

SEQ ID NO: 1588019 - RNA, 19 nt, Homo sapiens
gaagacacagaccgguuuc

SEQ ID NO: 1588020 - RNA, 19 nt, Homo sapiens
cagggcagcugugcagugu

SEQ ID NO: 1588021 - RNA, 19 nt, Homo sapiens
acagcaggcaugagacuaa

SEQ ID NO: 1588022 - RNA, 19 nt, Homo sapiens
cagccuauaauccuaagaa

SEQ ID NO: 1588023 - RNA, 19 nt, Homo sapiens
gauaaagagaacaaugaag

SEQ ID NO: 1588024 - RNA, 19 nt, Homo sapiens
acaucaaggucucacacuu

SEQ ID NO: 1588025 - RNA, 19 nt, Homo sapiens
cuacauggccuuuguucag

SEQ ID NO: 1588026 - RNA, 19 nt, Homo sapiens
ccaacgacaucaugcuacu

SEQ ID NO: 1588027 - RNA, 19 nt, Homo sapiens
caggguugcaggacuguaa

SEQ ID NO: 1588028 - RNA, 19 nt, Homo sapiens
cagagccacugagauuugu

SEQ ID NO: 1588029 - RNA, 19 nt, Homo sapiens
gggaagcuccauaaauguc

SEQ ID NO: 1588030 - RNA, 19 nt, Homo sapiens
uuccugcccuggauaaaga

SEQ ID NO: 1588031 - RNA, 19 nt, Homo sapiens
cuguuggccuuucuucuga

SEQ ID NO: 1588032 - RNA, 19 nt, Homo sapiens
gcggcauccuagugagaaa

SEQ ID NO: 1588033 - RNA, 19 nt, Homo sapiens
gauccaaagaagacacaga

SEQ ID NO: 1588034 - RNA, 19 nt, Homo sapiens
guugcaggacuguaauaaa

SEQ ID NO: 1588035 - RNA, 19 nt, Homo sapiens
gagguguggcggcauccua

SEQ ID NO: 1588036 - RNA, 19 nt, Homo sapiens
gguugcaggacuguaauaa

SEQ ID NO: 1588037 - RNA, 19 nt, Homo sapiens
aagguauucucuccuaugg

SEQ ID NO: 1588038 - RNA, 19 nt, Homo sapiens
ggcccacaauaucaaggaa

SEQ ID NO: 1588039 - RNA, 19 nt, Homo sapiens
ucucuuccauggcaauuac

SEQ ID NO: 1588040 - RNA, 19 nt, Homo sapiens
cccacaauaucaaggaaca

SEQ ID NO: 1588041 - RNA, 19 nt, Homo sapiens
ccucguguguaaggacgua

SEQ ID NO: 1588042 - RNA, 19 nt, Homo sapiens
cagcaaggcccaggugaag

SEQ ID NO: 1588043 - RNA, 19 nt, Homo sapiens
ggguugcaggacuguaaua

SEQ ID NO: 1588044 - RNA, 19 nt, Homo sapiens
gcaugagacuaaccuuccu

SEQ ID NO: 1588045 - RNA, 19 nt, Homo sapiens
aacaaugaagcgccucuaa

SEQ ID NO: 1588046 - RNA, 19 nt, Homo sapiens
ugccagggaagcuccauaa

SEQ ID NO: 1588047 - RNA, 19 nt, Homo sapiens
gcaggaaguguugcugaca

SEQ ID NO: 1588048 - RNA, 19 nt, Homo sapiens
gacacagaccgguuucaag

SEQ ID NO: 1588049 - RNA, 19 nt, Homo sapiens
agacacagaccgguuucaa

SEQ ID NO: 1588050 - RNA, 19 nt, Homo sapiens
gagccacugagauuugugu

SEQ ID NO: 1588051 - RNA, 19 nt, Homo sapiens
gcuccuagcuugaguguaa

SEQ ID NO: 1588052 - RNA, 19 nt, Homo sapiens
gacagcagguggcaucuua

SEQ ID NO: 1588053 - RNA, 19 nt, Homo sapiens
gguaguauauacacacaua

SEQ ID NO: 1588054 - RNA, 19 nt, Homo sapiens
gaagggaccugaacacgau

SEQ ID NO: 1588055 - RNA, 19 nt, Homo sapiens
gaagagaaaccugauguaa

SEQ ID NO: 1588056 - RNA, 19 nt, Homo sapiens
ucuaagagcuaaacguuaa

SEQ ID NO: 1588057 - RNA, 19 nt, Homo sapiens
gaugagggcuccugauugu

SEQ ID NO: 1588058 - RNA, 19 nt, Homo sapiens
gagacaaugugaauacuug

SEQ ID NO: 1588059 - RNA, 19 nt, Homo sapiens
caucuuacauugugauuug

SEQ ID NO: 1588060 - RNA, 19 nt, Homo sapiens
uaagaugccucccaaacuu

SEQ ID NO: 1588061 - RNA, 19 nt, Homo sapiens
guggaagccugaugcauuu

SEQ ID NO: 1588062 - RNA, 19 nt, Homo sapiens
gaacaaagaggcccagagu

SEQ ID NO: 1588063 - RNA, 19 nt, Homo sapiens
agagaaaccugauguaaag

SEQ ID NO: 1588064 - RNA, 19 nt, Homo sapiens
caaguuaucuccugugacu

SEQ ID NO: 1588065 - RNA, 19 nt, Homo sapiens
gcagguggcaucuuacauu

SEQ ID NO: 1588066 - RNA, 19 nt, Homo sapiens
gaagggauccaccuauuca

SEQ ID NO: 1588067 - RNA, 19 nt, Homo sapiens
gcuaaacguuaagauguaa

SEQ ID NO: 1588068 - RNA, 19 nt, Homo sapiens
guacagcagacgccuauaa

SEQ ID NO: 1588069 - RNA, 19 nt, Homo sapiens
gacaaguuaucuccuguga

SEQ ID NO: 1588070 - RNA, 19 nt, Homo sapiens
gagcuaaacguuaagaugu

SEQ ID NO: 1588071 - RNA, 19 nt, Homo sapiens
gaauaaacaagcaccuuug

SEQ ID NO: 1588072 - RNA, 19 nt, Homo sapiens
agaagaaaguggaaugugu

SEQ ID NO: 1588073 - RNA, 19 nt, Homo sapiens
gaaaccugauguaaagcaa

SEQ ID NO: 1588074 - RNA, 19 nt, Homo sapiens
ggaagagaaaccugaugua

SEQ ID NO: 1588075 - RNA, 19 nt, Homo sapiens
uguguuagcuuuguuaguu

SEQ ID NO: 1588076 - RNA, 19 nt, Homo sapiens
uagcuugaguguaaucuga

SEQ ID NO: 1588077 - RNA, 19 nt, Homo sapiens
gaaggagacaaugugaaua

SEQ ID NO: 1588078 - RNA, 19 nt, Homo sapiens
aagaagggauccaccuauu

SEQ ID NO: 1588079 - RNA, 19 nt, Homo sapiens
caaagaagaaaguggaaug

SEQ ID NO: 1588080 - RNA, 19 nt, Homo sapiens
gagcgagcuuugugguauu

SEQ ID NO: 1588081 - RNA, 19 nt, Homo sapiens
cagcagacgccuauaauuc

SEQ ID NO: 1588082 - RNA, 19 nt, Homo sapiens
acgcagagccuuaggaauu

SEQ ID NO: 1588083 - RNA, 19 nt, Homo sapiens
acacauacgcagagccuua

SEQ ID NO: 1588084 - RNA, 19 nt, Homo sapiens
cagcaggcuuuccauguga

SEQ ID NO: 1588085 - RNA, 19 nt, Homo sapiens
gaaaaggccccaaagaaga

SEQ ID NO: 1588086 - RNA, 19 nt, Homo sapiens
ggucagauucuaagagcua

SEQ ID NO: 1588087 - RNA, 19 nt, Homo sapiens
gauggcacgagacaaguua

SEQ ID NO: 1588088 - RNA, 19 nt, Homo sapiens
gguggcaucuuacauugug

SEQ ID NO: 1588089 - RNA, 19 nt, Homo sapiens
acaaagaggcccagaguca

SEQ ID NO: 1588090 - RNA, 19 nt, Homo sapiens
caaugugaauacuuggaaa

SEQ ID NO: 1588091 - RNA, 19 nt, Homo sapiens
ccagcaggcuuuccaugug

SEQ ID NO: 1588092 - RNA, 19 nt, Homo sapiens
agaaugcccugcccugugu

SEQ ID NO: 1588093 - RNA, 19 nt, Homo sapiens
ccagcgcuguccugucuuu

SEQ ID NO: 1588094 - RNA, 19 nt, Homo sapiens
cagguggcaucuuacauug

SEQ ID NO: 1588095 - RNA, 19 nt, Homo sapiens
gagcuuugugguauugaua

SEQ ID NO: 1588096 - RNA, 19 nt, Homo sapiens
ccacacacguacaauuucu

SEQ ID NO: 1588097 - RNA, 19 nt, Homo sapiens
ggauccaccuauucaguuc

SEQ ID NO: 1588098 - RNA, 19 nt, Homo sapiens
aagagaaaccugauguaaa

SEQ ID NO: 1588099 - RNA, 19 nt, Homo sapiens
gugacaguguguuagcuuu

SEQ ID NO: 1588100 - RNA, 19 nt, Homo sapiens
agaauaaacaagcaccuuu

SEQ ID NO: 1588101 - RNA, 19 nt, Homo sapiens
cagaugagggcuccugauu

SEQ ID NO: 1588102 - RNA, 19 nt, Homo sapiens
gaagccugaugcauuuagu

SEQ ID NO: 1588103 - RNA, 19 nt, Homo sapiens
ggaaaaggucagauucuaa

SEQ ID NO: 1588104 - RNA, 19 nt, Homo sapiens
ggagacaaugugaauacuu

SEQ ID NO: 1588105 - RNA, 19 nt, Homo sapiens
gagagcgagcuuuguggua

SEQ ID NO: 1588106 - RNA, 19 nt, Homo sapiens
gaagaaaguggucguucca

SEQ ID NO: 1588107 - RNA, 19 nt, Homo sapiens
aggagaaguugauggagaa

SEQ ID NO: 1588108 - RNA, 19 nt, Homo sapiens
gccuauaauucacaucuca

SEQ ID NO: 1588109 - RNA, 19 nt, Homo sapiens
agagcgagcuuugugguau

SEQ ID NO: 1588110 - RNA, 19 nt, Homo sapiens
uaaacaagcaccuuugcau

SEQ ID NO: 1588111 - RNA, 19 nt, Homo sapiens
cauacaggccuggguagua

SEQ ID NO: 1588112 - RNA, 19 nt, Homo sapiens
guguuagcuuuguuaguuu

SEQ ID NO: 1588113 - RNA, 19 nt, Homo sapiens
guuaagauguaauguucca

SEQ ID NO: 1588114 - RNA, 19 nt, Homo sapiens
gaauaagaugccucccaaa

SEQ ID NO: 1588115 - RNA, 19 nt, Homo sapiens
gcuuugugguauugauaaa

SEQ ID NO: 1588116 - RNA, 19 nt, Homo sapiens
gacaguguguuagcuuugu

SEQ ID NO: 1588117 - RNA, 19 nt, Homo sapiens
cgcagagccuuaggaauug

SEQ ID NO: 1588118 - RNA, 19 nt, Homo sapiens
acacacguacaauuucuaa

SEQ ID NO: 1588119 - RNA, 19 nt, Homo sapiens
agaaguugauggagaagca

SEQ ID NO: 1588120 - RNA, 19 nt, Homo sapiens
acguuaagauguaauguuc

SEQ ID NO: 1588121 - RNA, 19 nt, Homo sapiens
gggauccaccuauucaguu

SEQ ID NO: 1588122 - RNA, 19 nt, Homo sapiens
agaaggagacaaugugaau

SEQ ID NO: 1588123 - RNA, 19 nt, Homo sapiens
gaaugagacgcuagucagu

SEQ ID NO: 1588124 - RNA, 19 nt, Homo sapiens
gcagagccuuaggaauugu

SEQ ID NO: 1588125 - RNA, 19 nt, Homo sapiens
uguggaagccugaugcauu

SEQ ID NO: 1588126 - RNA, 19 nt, Homo sapiens
gccauggcacugagacuuu

SEQ ID NO: 1588127 - RNA, 19 nt, Homo sapiens
agcuaaacguuaagaugua

SEQ ID NO: 1588128 - RNA, 19 nt, Homo sapiens
acacguacaauuucuaauc

SEQ ID NO: 1588129 - RNA, 19 nt, Homo sapiens
ccagagucuuggacacaga

SEQ ID NO: 1588130 - RNA, 19 nt, Homo sapiens
ccugaugcauuuagugaca

SEQ ID NO: 1588131 - RNA, 19 nt, Homo sapiens
ugagucagcuuaugaaaag

SEQ ID NO: 1588132 - RNA, 19 nt, Homo sapiens
cuaaggagaaguugaugga

SEQ ID NO: 1588133 - RNA, 19 nt, Homo sapiens
ggagugaccagcagagaac

SEQ ID NO: 1588134 - RNA, 19 nt, Homo sapiens
ugccacacacguacaauuu

SEQ ID NO: 1588135 - RNA, 19 nt, Homo sapiens
gcgcuguccugucuuucug

SEQ ID NO: 1588136 - RNA, 19 nt, Homo sapiens
ccauggcacugagacuuug

SEQ ID NO: 1588137 - RNA, 19 nt, Homo sapiens
aaagaagggauccaccuau

SEQ ID NO: 1588138 - RNA, 19 nt, Homo sapiens
ucagaaggagacaauguga

SEQ ID NO: 1588139 - RNA, 19 nt, Homo sapiens
uaaaacacuucccuucguu

SEQ ID NO: 1588140 - RNA, 19 nt, Homo sapiens
ucagagagcgagcuuugug

SEQ ID NO: 1588141 - RNA, 19 nt, Homo sapiens
aagauguaauguuccagaa

SEQ ID NO: 1588142 - RNA, 19 nt, Homo sapiens
augagacgcuagucaguug

SEQ ID NO: 1588143 - RNA, 19 nt, Homo sapiens
gcagacgccuauaauucac

SEQ ID NO: 1588144 - RNA, 19 nt, Homo sapiens
gggagugaccagcagagaa

SEQ ID NO: 1588145 - RNA, 19 nt, Homo sapiens
ggaagccugaugcauuuag

SEQ ID NO: 1588146 - RNA, 19 nt, Homo sapiens
gaaaaggucagauucuaag

SEQ ID NO: 1588147 - RNA, 19 nt, Homo sapiens
caaaaucuaaggagaaguu

SEQ ID NO: 1588148 - RNA, 19 nt, Homo sapiens
gaccagcagagaaccauuc

SEQ ID NO: 1588149 - RNA, 19 nt, Homo sapiens
ugccagcgcuguccugucu

SEQ ID NO: 1588150 - RNA, 19 nt, Homo sapiens
gaaaggccaaucaaaacuu

SEQ ID NO: 1588151 - RNA, 19 nt, Homo sapiens
gaaagaugcucuacauuau

SEQ ID NO: 1588152 - RNA, 19 nt, Homo sapiens
gcaaugagccaucaacuaa

SEQ ID NO: 1588153 - RNA, 19 nt, Homo sapiens
gaaacuggcuuagugauug

SEQ ID NO: 1588154 - RNA, 19 nt, Homo sapiens
guacuuuacugcucuuaua

SEQ ID NO: 1588155 - RNA, 19 nt, Homo sapiens
ugaaagaugcucuacauua

SEQ ID NO: 1588156 - RNA, 19 nt, Homo sapiens
aaucaaagccucuucauaa

SEQ ID NO: 1588157 - RNA, 19 nt, Homo sapiens
caaagggaauaaugaacua

SEQ ID NO: 1588158 - RNA, 19 nt, Homo sapiens
aguagaagaugaagacaua

SEQ ID NO: 1588159 - RNA, 19 nt, Homo sapiens
gcaucuuucuuguacuuua

SEQ ID NO: 1588160 - RNA, 19 nt, Homo sapiens
caaagccucuucauaauac

SEQ ID NO: 1588161 - RNA, 19 nt, Homo sapiens
caaaagaagucaucuaguu

SEQ ID NO: 1588162 - RNA, 19 nt, Homo sapiens
uggauuaucuuggcuauuu

SEQ ID NO: 1588163 - RNA, 19 nt, Homo sapiens
caaaccuucugcaacaaua

SEQ ID NO: 1588164 - RNA, 19 nt, Homo sapiens
gaagucaucuaguucaucu

SEQ ID NO: 1588165 - RNA, 19 nt, Homo sapiens
gaggaauaaugacccagua

SEQ ID NO: 1588166 - RNA, 19 nt, Homo sapiens
acugaaacaucucucaaua

SEQ ID NO: 1588167 - RNA, 19 nt, Homo sapiens
ucaaagccucuucauaaua

SEQ ID NO: 1588168 - RNA, 19 nt, Homo sapiens
caagaugauauuccacuua

SEQ ID NO: 1588169 - RNA, 19 nt, Homo sapiens
gcucaccuuuggaggaaua

SEQ ID NO: 1588170 - RNA, 19 nt, Homo sapiens
gcucuuauacuaucucuga

SEQ ID NO: 1588171 - RNA, 19 nt, Homo sapiens
aagaugcucuacauuauga

SEQ ID NO: 1588172 - RNA, 19 nt, Homo sapiens
ugaguacaauuucagcuuu

SEQ ID NO: 1588173 - RNA, 19 nt, Homo sapiens
uuacacaccuucuucuguu

SEQ ID NO: 1588174 - RNA, 19 nt, Homo sapiens
gcaaaugacaagugacaga

SEQ ID NO: 1588175 - RNA, 19 nt, Homo sapiens
gaagaugaagacauaauca

SEQ ID NO: 1588176 - RNA, 19 nt, Homo sapiens
ccaaugagcuaggaguaga

SEQ ID NO: 1588177 - RNA, 19 nt, Homo sapiens
ucucaaaccuucugcaaca

SEQ ID NO: 1588178 - RNA, 19 nt, Homo sapiens
gggaauguauguuuuguuu

SEQ ID NO: 1588179 - RNA, 19 nt, Homo sapiens
agccauaacuuaaauagug

SEQ ID NO: 1588180 - RNA, 19 nt, Homo sapiens
cuacagcuuuagcaucuuu

SEQ ID NO: 1588181 - RNA, 19 nt, Homo sapiens
caggaugauuggucucuuu

SEQ ID NO: 1588182 - RNA, 19 nt, Homo sapiens
gugacagaauccaccuuua

SEQ ID NO: 1588183 - RNA, 19 nt, Homo sapiens
aaggcuaccucuugaauug

SEQ ID NO: 1588184 - RNA, 19 nt, Homo sapiens
caacuaaagaacucaaaga

SEQ ID NO: 1588185 - RNA, 19 nt, Homo sapiens
gaaaccagcaagugaaagu

SEQ ID NO: 1588186 - RNA, 19 nt, Homo sapiens
guucagaguugauaaagac

SEQ ID NO: 1588187 - RNA, 19 nt, Homo sapiens
gaauaugguagaagggaaa

SEQ ID NO: 1588188 - RNA, 19 nt, Homo sapiens
ugacaaagggaauaaugaa

SEQ ID NO: 1588189 - RNA, 19 nt, Homo sapiens
gagacuuccuccacccaaa

SEQ ID NO: 1588190 - RNA, 19 nt, Homo sapiens
caguagcaauccgaaauuu

SEQ ID NO: 1588191 - RNA, 19 nt, Homo sapiens
guggaauauuguugugaua

SEQ ID NO: 1588192 - RNA, 19 nt, Homo sapiens
uagcaucuuucuuguacuu

SEQ ID NO: 1588193 - RNA, 19 nt, Homo sapiens
ccagagauguggcacuuac

SEQ ID NO: 1588194 - RNA, 19 nt, Homo sapiens
ugagcaaacuacuguggaa

SEQ ID NO: 1588195 - RNA, 19 nt, Homo sapiens
aaacuggcuuagugauuga

SEQ ID NO: 1588196 - RNA, 19 nt, Homo sapiens
cccaguauuugucccauuu

SEQ ID NO: 1588197 - RNA, 19 nt, Homo sapiens
gagaucagcuauccaaccu

SEQ ID NO: 1588198 - RNA, 19 nt, Homo sapiens
gaacuagaaaccagcaagu

SEQ ID NO: 1588199 - RNA, 19 nt, Homo sapiens
cgugguggcucuucugguu

SEQ ID NO: 1588200 - RNA, 19 nt, Homo sapiens
uuacugcucuuauacuauc

SEQ ID NO: 1588201 - RNA, 19 nt, Homo sapiens
gaggaggcaguuauucaaa

SEQ ID NO: 1588202 - RNA, 19 nt, Homo sapiens
gcaagugaaaguguuuauu

SEQ ID NO: 1588203 - RNA, 19 nt, Homo sapiens
cauaauaccagcucaccuu

SEQ ID NO: 1588204 - RNA, 19 nt, Homo sapiens
ggaagcaggaauugaggaa

SEQ ID NO: 1588205 - RNA, 19 nt, Homo sapiens
gaauuacaguaugccaaug

SEQ ID NO: 1588206 - RNA, 19 nt, Homo sapiens
ugugauauauguucuagca

SEQ ID NO: 1588207 - RNA, 19 nt, Homo sapiens
ggcaaugagccaucaacua

SEQ ID NO: 1588208 - RNA, 19 nt, Homo sapiens
gaugauauuccacuuaguc

SEQ ID NO: 1588209 - RNA, 19 nt, Homo sapiens
aagaugauauuccacuuag

SEQ ID NO: 1588210 - RNA, 19 nt, Homo sapiens
cuugaaagaugcucuacau

SEQ ID NO: 1588211 - RNA, 19 nt, Homo sapiens
gggaauaaugaacuagaaa

SEQ ID NO: 1588212 - RNA, 19 nt, Homo sapiens
cagcucaccuuuggaggaa

SEQ ID NO: 1588213 - RNA, 19 nt, Homo sapiens
gacccuagcguauccauuc

SEQ ID NO: 1588214 - RNA, 19 nt, Homo sapiens
gccauaacuuaaauagugu

SEQ ID NO: 1588215 - RNA, 19 nt, Homo sapiens
aaaucaaagccucuucaua

SEQ ID NO: 1588216 - RNA, 19 nt, Homo sapiens
gaaaucaaagccucuucau

SEQ ID NO: 1588217 - RNA, 19 nt, Homo sapiens
uacacaccuucuucuguua

SEQ ID NO: 1588218 - RNA, 19 nt, Homo sapiens
gcugugcuguguggaauau

SEQ ID NO: 1588219 - RNA, 19 nt, Homo sapiens
gaccuccccuuacugaaua

SEQ ID NO: 1588220 - RNA, 19 nt, Homo sapiens
aggcauggaucuuagugaa

SEQ ID NO: 1588221 - RNA, 19 nt, Homo sapiens
caaaugacaagugacagaa

SEQ ID NO: 1588222 - RNA, 19 nt, Homo sapiens
caccagagauguggcacuu

SEQ ID NO: 1588223 - RNA, 19 nt, Homo sapiens
augaagacauaaucacuga

SEQ ID NO: 1588224 - RNA, 19 nt, Homo sapiens
caaaucaccgccaccacuu

SEQ ID NO: 1588225 - RNA, 19 nt, Homo sapiens
ucaagaugauauuccacuu

SEQ ID NO: 1588226 - RNA, 19 nt, Homo sapiens
gcuaggaguagaagaugaa

SEQ ID NO: 1588227 - RNA, 19 nt, Homo sapiens
cagcagaauuacaguaugc

SEQ ID NO: 1588228 - RNA, 19 nt, Homo sapiens
aaacccagccagcagaauu

SEQ ID NO: 1588229 - RNA, 19 nt, Homo sapiens
ugaaacuggcuuagugauu

SEQ ID NO: 1588230 - RNA, 19 nt, Homo sapiens
ggaaggccuugcucagacu

SEQ ID NO: 1588231 - RNA, 19 nt, Homo sapiens
gacagaauccaccuuuaca

SEQ ID NO: 1588232 - RNA, 19 nt, Homo sapiens
gucuagcauuaucaucuua

SEQ ID NO: 1588233 - RNA, 19 nt, Homo sapiens
aagcaggaauugaggaaca

SEQ ID NO: 1588234 - RNA, 19 nt, Homo sapiens
cgggaaagcugugauugca

SEQ ID NO: 1588235 - RNA, 19 nt, Homo sapiens
ccuggauccuacagcuuua

SEQ ID NO: 1588236 - RNA, 19 nt, Homo sapiens
gucaucuaguucaucuuua

SEQ ID NO: 1588237 - RNA, 19 nt, Homo sapiens
aaugagccaucaacuaaag

SEQ ID NO: 1588238 - RNA, 19 nt, Homo sapiens
cuagaaaccagcaagugaa

SEQ ID NO: 1588239 - RNA, 19 nt, Homo sapiens
ggaauaaugaacuagaaac

SEQ ID NO: 1588240 - RNA, 19 nt, Homo sapiens
gugaagaguuaauguucuc

SEQ ID NO: 1588241 - RNA, 19 nt, Homo sapiens
ggccaggcauggaucuuag

SEQ ID NO: 1588242 - RNA, 19 nt, Homo sapiens
ggauugacuuugcuaaaau

SEQ ID NO: 1588243 - RNA, 19 nt, Homo sapiens
ggcauuagccagccuguag

SEQ ID NO: 1588244 - RNA, 19 nt, Homo sapiens
cccagaggcuccuguucaa

SEQ ID NO: 1588245 - RNA, 19 nt, Homo sapiens
caaugagccaucaacuaaa

SEQ ID NO: 1588246 - RNA, 19 nt, Homo sapiens
aaagaagucaucuaguuca

SEQ ID NO: 1588247 - RNA, 19 nt, Homo sapiens
cuuuacugcucuuauacua

SEQ ID NO: 1588248 - RNA, 19 nt, Homo sapiens
ccagcagaauuacaguaug

SEQ ID NO: 1588249 - RNA, 19 nt, Homo sapiens
uagaaaccagcaagugaaa

SEQ ID NO: 1588250 - RNA, 19 nt, Homo sapiens
aauaccagcucaccuuugg

SEQ ID NO: 1588251 - RNA, 19 nt, Homo sapiens
gacaggauaucuuccauaa

SEQ ID NO: 1588252 - RNA, 19 nt, Homo sapiens
ugacuacucuccucuuuaa

SEQ ID NO: 1588253 - RNA, 19 nt, Homo sapiens
gaugugauauggcuugaaa

SEQ ID NO: 1588254 - RNA, 19 nt, Homo sapiens
cagaacagcuuuacuuuag

SEQ ID NO: 1588255 - RNA, 19 nt, Homo sapiens
gaacagcuuuacuuuagau

SEQ ID NO: 1588256 - RNA, 19 nt, Homo sapiens
gaucauugguuuaucauag

SEQ ID NO: 1588257 - RNA, 19 nt, Homo sapiens
cagcagagguuucccuuga

SEQ ID NO: 1588258 - RNA, 19 nt, Homo sapiens
gaaauugccuucccucacu

SEQ ID NO: 1588259 - RNA, 19 nt, Homo sapiens
uagauaggguuccauuuaa

SEQ ID NO: 1588260 - RNA, 19 nt, Homo sapiens
caagaucauugguuuauca

SEQ ID NO: 1588261 - RNA, 19 nt, Homo sapiens
gaucagaacagcuuuacuu

SEQ ID NO: 1588262 - RNA, 19 nt, Homo sapiens
gaaaguaggcuaagcuagu

SEQ ID NO: 1588263 - RNA, 19 nt, Homo sapiens
cguauuaacuggcagagaa

SEQ ID NO: 1588264 - RNA, 19 nt, Homo sapiens
gcugggaccucaucauaga

SEQ ID NO: 1588265 - RNA, 19 nt, Homo sapiens
caagagagagggcguuaaa

SEQ ID NO: 1588266 - RNA, 19 nt, Homo sapiens
uuagauaggguuccauuua

SEQ ID NO: 1588267 - RNA, 19 nt, Homo sapiens
ggagagacguggguugaga

SEQ ID NO: 1588268 - RNA, 19 nt, Homo sapiens
gaaagucaccaucaucugu

SEQ ID NO: 1588269 - RNA, 19 nt, Homo sapiens
gaccaagucuagcagauuc

SEQ ID NO: 1588270 - RNA, 19 nt, Homo sapiens
cguauaagauuccgugguu

SEQ ID NO: 1588271 - RNA, 19 nt, Homo sapiens
caggauaucuuccauaaaa

SEQ ID NO: 1588272 - RNA, 19 nt, Homo sapiens
uuacaaggcucuaaaauga

SEQ ID NO: 1588273 - RNA, 19 nt, Homo sapiens
gagagggcguuaaagaugu

SEQ ID NO: 1588274 - RNA, 19 nt, Homo sapiens
gagaucaggcuguuccuuu

SEQ ID NO: 1588275 - RNA, 19 nt, Homo sapiens
uagcugcagccuuaaauua

SEQ ID NO: 1588276 - RNA, 19 nt, Homo sapiens
ucagaacagcuuuacuuua

SEQ ID NO: 1588277 - RNA, 19 nt, Homo sapiens
caugaggccucuugccaaa

SEQ ID NO: 1588278 - RNA, 19 nt, Homo sapiens
agacguggguugagaauag

SEQ ID NO: 1588279 - RNA, 19 nt, Homo sapiens
ucacuaagguggaaauugc

SEQ ID NO: 1588280 - RNA, 19 nt, Homo sapiens
ggagacacuuucugacagu

SEQ ID NO: 1588281 - RNA, 19 nt, Homo sapiens
cagcugggaccucaucaua

SEQ ID NO: 1588282 - RNA, 19 nt, Homo sapiens
gcagagguuucccuugaag

SEQ ID NO: 1588283 - RNA, 19 nt, Homo sapiens
gcucgaccuugcucuuauu

SEQ ID NO: 1588284 - RNA, 19 nt, Homo sapiens
ggaagcaguaccuggaauu

SEQ ID NO: 1588285 - RNA, 19 nt, Homo sapiens
gggaggagacacuuucuga

SEQ ID NO: 1588286 - RNA, 19 nt, Homo sapiens
gagagagggcguuaaagau

SEQ ID NO: 1588287 - RNA, 19 nt, Homo sapiens
cgaccuugcucuuauuagu

SEQ ID NO: 1588288 - RNA, 19 nt, Homo sapiens
gauaggguuccauuuaaga

SEQ ID NO: 1588289 - RNA, 19 nt, Homo sapiens
gaucuuggacaaauuauac

SEQ ID NO: 1588290 - RNA, 19 nt, Homo sapiens
ugagaauaguguaaacuuc

SEQ ID NO: 1588291 - RNA, 19 nt, Homo sapiens
aagaugggacacuuuaaua

SEQ ID NO: 1588292 - RNA, 19 nt, Homo sapiens
gaggagacacuuucugaca

SEQ ID NO: 1588293 - RNA, 19 nt, Homo sapiens
ggaccaagucuagcagauu

SEQ ID NO: 1588294 - RNA, 19 nt, Homo sapiens
cuacucuccucuuuaauag

SEQ ID NO: 1588295 - RNA, 19 nt, Homo sapiens
ucacauuggccaagcauga

SEQ ID NO: 1588296 - RNA, 19 nt, Homo sapiens
gcaagaucauugguuuauc

SEQ ID NO: 1588297 - RNA, 19 nt, Homo sapiens
gggcaagaucauugguuua

SEQ ID NO: 1588298 - RNA, 19 nt, Homo sapiens
acucuccucuuuaauagaa

SEQ ID NO: 1588299 - RNA, 19 nt, Homo sapiens
gauaugugggagaaccuua

SEQ ID NO: 1588300 - RNA, 19 nt, Homo sapiens
agagagagggcguuaaaga

SEQ ID NO: 1588301 - RNA, 19 nt, Homo sapiens
aaaguaggcuaagcuagug

SEQ ID NO: 1588302 - RNA, 19 nt, Homo sapiens
ugggcaagaucauugguuu

SEQ ID NO: 1588303 - RNA, 19 nt, Homo sapiens
gaggagagacguggguuga

SEQ ID NO: 1588304 - RNA, 19 nt, Homo sapiens
gaagcaguaccuggaauug

SEQ ID NO: 1588305 - RNA, 19 nt, Homo sapiens
gaaaugggaggagacacuu

SEQ ID NO: 1588306 - RNA, 19 nt, Homo sapiens
ucucacccacugcguauua

SEQ ID NO: 1588307 - RNA, 19 nt, Homo sapiens
ggcuggaacuucugcucua

SEQ ID NO: 1588308 - RNA, 19 nt, Homo sapiens
acuacucuccucuuuaaua

SEQ ID NO: 1588309 - RNA, 19 nt, Homo sapiens
guaaaagcgugaccacaga

SEQ ID NO: 1588310 - RNA, 19 nt, Homo sapiens
uggagggucuucagaguuc

SEQ ID NO: 1588311 - RNA, 19 nt, Homo sapiens
aggguuccauuuaagauuu

SEQ ID NO: 1588312 - RNA, 19 nt, Homo sapiens
ggucacuuauauaaagaug

SEQ ID NO: 1588313 - RNA, 19 nt, Homo sapiens
uaauagaaagucaccauca

SEQ ID NO: 1588314 - RNA, 19 nt, Homo sapiens
gagaugugauauggcuuga

SEQ ID NO: 1588315 - RNA, 19 nt, Homo sapiens
agagggcguuaaagaugua

SEQ ID NO: 1588316 - RNA, 19 nt, Homo sapiens
uuaacuggcagagaauuua

SEQ ID NO: 1588317 - RNA, 19 nt, Homo sapiens
gccuuaaauuagcuucuuu

SEQ ID NO: 1588318 - RNA, 19 nt, Homo sapiens
ggcaagaucauugguuuau

SEQ ID NO: 1588319 - RNA, 19 nt, Homo sapiens
agaugggacacuuuaauaa

SEQ ID NO: 1588320 - RNA, 19 nt, Homo sapiens
uugaauggcuuucucacau

SEQ ID NO: 1588321 - RNA, 19 nt, Homo sapiens
ggugggagaucaggcuguu

SEQ ID NO: 1588322 - RNA, 19 nt, Homo sapiens
ugccuucccucacuacuga

SEQ ID NO: 1588323 - RNA, 19 nt, Homo sapiens
ggaucuuggacaaauuaua

SEQ ID NO: 1588324 - RNA, 19 nt, Homo sapiens
aaagucaccaucaucugua

SEQ ID NO: 1588325 - RNA, 19 nt, Homo sapiens
ggucuggaauggaauuggu

SEQ ID NO: 1588326 - RNA, 19 nt, Homo sapiens
agagagggcguuaaagaug

SEQ ID NO: 1588327 - RNA, 19 nt, Homo sapiens
acagaugaguggaagaaag

SEQ ID NO: 1588328 - RNA, 19 nt, Homo sapiens
ucucugggaggcauuauaa

SEQ ID NO: 1588329 - RNA, 19 nt, Homo sapiens
guaggugccucagggacuu

SEQ ID NO: 1588330 - RNA, 19 nt, Homo sapiens
gaucaucuaccugcaguuc

SEQ ID NO: 1588331 - RNA, 19 nt, Homo sapiens
agaucaggcuguuccuuug

SEQ ID NO: 1588332 - RNA, 19 nt, Homo sapiens
guagcuccguauaagauuc

SEQ ID NO: 1588333 - RNA, 19 nt, Homo sapiens
gcuggaacuucugcucuau

SEQ ID NO: 1588334 - RNA, 19 nt, Homo sapiens
aauagaaagucaccaucau

SEQ ID NO: 1588335 - RNA, 19 nt, Homo sapiens
gaagauggaggaggcaaag

SEQ ID NO: 1588336 - RNA, 19 nt, Homo sapiens
cagcuuuacuuuagauagg

SEQ ID NO: 1588337 - RNA, 19 nt, Homo sapiens
gcucuaaaaugagauguga

SEQ ID NO: 1588338 - RNA, 19 nt, Homo sapiens
gcaagagagagggcguuaa

SEQ ID NO: 1588339 - RNA, 19 nt, Homo sapiens
agaacagcuuuacuuuaga

SEQ ID NO: 1588340 - RNA, 19 nt, Homo sapiens
cuugacuacucuccucuuu

SEQ ID NO: 1588341 - RNA, 19 nt, Homo sapiens
aaaaugagaugugauaugg

SEQ ID NO: 1588342 - RNA, 19 nt, Homo sapiens
uggguucuuugcugaaauu

SEQ ID NO: 1588343 - RNA, 19 nt, Homo sapiens
gagagacguggguugagaa

SEQ ID NO: 1588344 - RNA, 19 nt, Homo sapiens
aaauugccuucccucacua

SEQ ID NO: 1588345 - RNA, 19 nt, Homo sapiens
agacaggauaucuuccaua

SEQ ID NO: 1588346 - RNA, 19 nt, Homo sapiens
cugacgagaccauguguaa

SEQ ID NO: 1588347 - RNA, 19 nt, Homo sapiens
cucaugaucucccacuuuc

SEQ ID NO: 1588348 - RNA, 19 nt, Homo sapiens
ccucaugaucucccacuuu

SEQ ID NO: 1588349 - RNA, 19 nt, Homo sapiens
aggacugggugaucucaaa

SEQ ID NO: 1588350 - RNA, 19 nt, Homo sapiens
ggucauccucuuccacaug

SEQ ID NO: 1588351 - RNA, 19 nt, Homo sapiens
ucaaguagcugagauuaua

SEQ ID NO: 1588352 - RNA, 19 nt, Homo sapiens
gagcaaggcuuuccaauac

SEQ ID NO: 1588353 - RNA, 19 nt, Homo sapiens
gaaugggucuuacucuuug

SEQ ID NO: 1588354 - RNA, 19 nt, Homo sapiens
guacugugcuuauuuguuc

SEQ ID NO: 1588355 - RNA, 19 nt, Homo sapiens
gaaacagaaucgccuggaa

SEQ ID NO: 1588356 - RNA, 19 nt, Homo sapiens
gaaaaugccuuuaucaaca

SEQ ID NO: 1588357 - RNA, 19 nt, Homo sapiens
cgaggugacuucccaauug

SEQ ID NO: 1588358 - RNA, 19 nt, Homo sapiens
caauugcccuugagcauga

SEQ ID NO: 1588359 - RNA, 19 nt, Homo sapiens
gaagcaggaguccgaguua

SEQ ID NO: 1588360 - RNA, 19 nt, Homo sapiens
gagcaugauucgaaaggaa

SEQ ID NO: 1588361 - RNA, 19 nt, Homo sapiens
aaagagacccugagcuuaa

SEQ ID NO: 1588362 - RNA, 19 nt, Homo sapiens
caaccaagcccacagcauu

SEQ ID NO: 1588363 - RNA, 19 nt, Homo sapiens
uagcugagauuauagugaa

SEQ ID NO: 1588364 - RNA, 19 nt, Homo sapiens
cuacgagucuugcuugcua

SEQ ID NO: 1588365 - RNA, 19 nt, Homo sapiens
gggaucaucugucucuguu

SEQ ID NO: 1588366 - RNA, 19 nt, Homo sapiens
aaauugagaagcuggauua

SEQ ID NO: 1588367 - RNA, 19 nt, Homo sapiens
ccaggugccuuccauuaga

SEQ ID NO: 1588368 - RNA, 19 nt, Homo sapiens
aguuaaaccuucaguugua

SEQ ID NO: 1588369 - RNA, 19 nt, Homo sapiens
gaagcuggauuaccaucau

SEQ ID NO: 1588370 - RNA, 19 nt, Homo sapiens
gcaaggcuuuccaauacau

SEQ ID NO: 1588371 - RNA, 19 nt, Homo sapiens
uagcagcugugcggaauaa

SEQ ID NO: 1588372 - RNA, 19 nt, Homo sapiens
caccucagccucucaagua

SEQ ID NO: 1588373 - RNA, 19 nt, Homo sapiens
cagccucacucucugguuu

SEQ ID NO: 1588374 - RNA, 19 nt, Homo sapiens
gcaaggaauccacgacaug

SEQ ID NO: 1588375 - RNA, 19 nt, Homo sapiens
gacauuucccuaugaguuu

SEQ ID NO: 1588376 - RNA, 19 nt, Homo sapiens
cgaguuaaaccuucaguug

SEQ ID NO: 1588377 - RNA, 19 nt, Homo sapiens
ugaaugggucuuacucuuu

SEQ ID NO: 1588378 - RNA, 19 nt, Homo sapiens
ccuggaagguagaaauuga

SEQ ID NO: 1588379 - RNA, 19 nt, Homo sapiens
cagaaucgccuggaaggua

SEQ ID NO: 1588380 - RNA, 19 nt, Homo sapiens
gaacacggugggaacaaga

SEQ ID NO: 1588381 - RNA, 19 nt, Homo sapiens
gaagguagaaauugagaag

SEQ ID NO: 1588382 - RNA, 19 nt, Homo sapiens
gauccuaccuguccuucca

SEQ ID NO: 1588383 - RNA, 19 nt, Homo sapiens
gaugggcuuugugaaauga

SEQ ID NO: 1588384 - RNA, 19 nt, Homo sapiens
gaaauugagaagcuggauu

SEQ ID NO: 1588385 - RNA, 19 nt, Homo sapiens
caaaugcccagacaagaug

SEQ ID NO: 1588386 - RNA, 19 nt, Homo sapiens
acccugagcuuaaacaaau

SEQ ID NO: 1588387 - RNA, 19 nt, Homo sapiens
caauugcuguucugugugu

SEQ ID NO: 1588388 - RNA, 19 nt, Homo sapiens
agagcaaggcuuuccaaua

SEQ ID NO: 1588389 - RNA, 19 nt, Homo sapiens
ggauuaccaucauuaucug

SEQ ID NO: 1588390 - RNA, 19 nt, Homo sapiens
ggaagaugguggcagaaaa

SEQ ID NO: 1588391 - RNA, 19 nt, Homo sapiens
guucagcagugccucucua

SEQ ID NO: 1588392 - RNA, 19 nt, Homo sapiens
gaacuccggagacggcauu

SEQ ID NO: 1588393 - RNA, 19 nt, Homo sapiens
gaauaugaaugggucuuac

SEQ ID NO: 1588394 - RNA, 19 nt, Homo sapiens
uuaaacaaaugcccagaca

SEQ ID NO: 1588395 - RNA, 19 nt, Homo sapiens
cagaagagggagaacauug

SEQ ID NO: 1588396 - RNA, 19 nt, Homo sapiens
caccugggcucaagugauc

SEQ ID NO: 1588397 - RNA, 19 nt, Homo sapiens
ugacauuucccuaugaguu

SEQ ID NO: 1588398 - RNA, 19 nt, Homo sapiens
gcaggggcauuuaaagaaa

SEQ ID NO: 1588399 - RNA, 19 nt, Homo sapiens
aaacaaaugcccagacaag

SEQ ID NO: 1588400 - RNA, 19 nt, Homo sapiens
cagacaagaugccgaagag

SEQ ID NO: 1588401 - RNA, 19 nt, Homo sapiens
gaguuaaaccuucaguugu

SEQ ID NO: 1588402 - RNA, 19 nt, Homo sapiens
ucucauuccuugugacuuc

SEQ ID NO: 1588403 - RNA, 19 nt, Homo sapiens
ggaacacggugggaacaag

SEQ ID NO: 1588404 - RNA, 19 nt, Homo sapiens
ccaagcugcuggcacaaca

SEQ ID NO: 1588405 - RNA, 19 nt, Homo sapiens
aguuuaugcugacugcuua

SEQ ID NO: 1588406 - RNA, 19 nt, Homo sapiens
guuaaaccuucaguuguau

SEQ ID NO: 1588407 - RNA, 19 nt, Homo sapiens
ggacuguuagcccuauuga

SEQ ID NO: 1588408 - RNA, 19 nt, Homo sapiens
aagagacccugagcuuaaa

SEQ ID NO: 1588409 - RNA, 19 nt, Homo sapiens
gaagagaagcauggguuca

SEQ ID NO: 1588410 - RNA, 19 nt, Homo sapiens
uuauacagcuccgacagaa

SEQ ID NO: 1588411 - RNA, 19 nt, Homo sapiens
uugagaagcuggauuacca

SEQ ID NO: 1588412 - RNA, 19 nt, Homo sapiens
gcggaauaaugugcuuuga

SEQ ID NO: 1588413 - RNA, 19 nt, Homo sapiens
gcagcugugcggaauaaug

SEQ ID NO: 1588414 - RNA, 19 nt, Homo sapiens
ugaaagagccccacagaga

SEQ ID NO: 1588415 - RNA, 19 nt, Homo sapiens
ccguaaagcccacugauuc

SEQ ID NO: 1588416 - RNA, 19 nt, Homo sapiens
gcagaagagggagaacauu

SEQ ID NO: 1588417 - RNA, 19 nt, Homo sapiens
caccacaaccggccaguga

SEQ ID NO: 1588418 - RNA, 19 nt, Homo sapiens
gguuguaagggaagaguuu

SEQ ID NO: 1588419 - RNA, 19 nt, Homo sapiens
aagcaggaguccgaguuaa

SEQ ID NO: 1588420 - RNA, 19 nt, Homo sapiens
gaggugacuucccaauugc

SEQ ID NO: 1588421 - RNA, 19 nt, Homo sapiens
gcgaggugacuucccaauu

SEQ ID NO: 1588422 - RNA, 19 nt, Homo sapiens
ucaagguccuccagcaucu

SEQ ID NO: 1588423 - RNA, 19 nt, Homo sapiens
agucaaagccaugaugaaa

SEQ ID NO: 1588424 - RNA, 19 nt, Homo sapiens
gacccugagcuuaaacaaa

SEQ ID NO: 1588425 - RNA, 19 nt, Homo sapiens
cuagguguuugucauggaa

SEQ ID NO: 1588426 - RNA, 19 nt, Homo sapiens
uaugcugacugcuuacuag

SEQ ID NO: 1588427 - RNA, 19 nt, Homo sapiens
ggugaugucagagguugua

SEQ ID NO: 1588428 - RNA, 19 nt, Homo sapiens
ucuaagagaagaauugcuu

SEQ ID NO: 1588429 - RNA, 19 nt, Homo sapiens
acaauaguguacugugcuu

SEQ ID NO: 1588430 - RNA, 19 nt, Homo sapiens
acuguuagcccuauugaga

SEQ ID NO: 1588431 - RNA, 19 nt, Homo sapiens
agucuugcuugcuaaacua

SEQ ID NO: 1588432 - RNA, 19 nt, Homo sapiens
gagaaaaugccuuuaucaa

SEQ ID NO: 1588433 - RNA, 19 nt, Homo sapiens
acaaaugcccagacaagau

SEQ ID NO: 1588434 - RNA, 19 nt, Homo sapiens
guaaagcccacugauucuu

SEQ ID NO: 1588435 - RNA, 19 nt, Homo sapiens
aauaaugugcuuugacguu

SEQ ID NO: 1588436 - RNA, 19 nt, Homo sapiens
gagucuugcuugcuaaacu

SEQ ID NO: 1588437 - RNA, 19 nt, Homo sapiens
gagacggcauugacuacag

SEQ ID NO: 1588438 - RNA, 19 nt, Homo sapiens
agaauaugaaugggucuua

SEQ ID NO: 1588439 - RNA, 19 nt, Homo sapiens
ggcaaggaauccacgacau

SEQ ID NO: 1588440 - RNA, 19 nt, Homo sapiens
ugaugggcuuugugaaaug

SEQ ID NO: 1588441 - RNA, 19 nt, Homo sapiens
cagcugugcggaauaaugu

SEQ ID NO: 1588442 - RNA, 19 nt, Homo sapiens
ugccuuccauuagaguuua

SEQ ID NO: 1588443 - RNA, 19 nt, Homo sapiens
gaguuuaugcugacugcuu

SEQ ID NO: 1588444 - RNA, 19 nt, Homo sapiens
gacuacagccagcagaaga

SEQ ID NO: 1588445 - RNA, 19 nt, Homo sapiens
ucugaggguuucacaguca

SEQ ID NO: 1588446 - RNA, 19 nt, Homo sapiens
cagcagugccucucuagca

SEQ ID NO: 1588447 - RNA, 19 nt, Homo sapiens
aguguacugugcuuauuug

SEQ ID NO: 1588448 - RNA, 19 nt, Homo sapiens
caaggcuuuccaauacaua

SEQ ID NO: 1588449 - RNA, 19 nt, Homo sapiens
cuauugagagcaaggcuuu

SEQ ID NO: 1588450 - RNA, 19 nt, Homo sapiens
gaaaccucccguugguguu

SEQ ID NO: 1588451 - RNA, 19 nt, Homo sapiens
gcaaauaacugcacuaagg

SEQ ID NO: 1588452 - RNA, 19 nt, Homo sapiens
ggacagagaagguuaaucu

SEQ ID NO: 1588453 - RNA, 19 nt, Homo sapiens
gauaacaacagucgaagaa

SEQ ID NO: 1588454 - RNA, 19 nt, Homo sapiens
gcaaaguuguuggcuggua

SEQ ID NO: 1588455 - RNA, 19 nt, Homo sapiens
ucaaacagauaacaacagu

SEQ ID NO: 1588456 - RNA, 19 nt, Homo sapiens
gaacuggaaccgaaagcaa

SEQ ID NO: 1588457 - RNA, 19 nt, Homo sapiens
gaugcaagaaucugacuuu

SEQ ID NO: 1588458 - RNA, 19 nt, Homo sapiens
uaacaacagucgaagaacu

SEQ ID NO: 1588459 - RNA, 19 nt, Homo sapiens
gaaucugacuuucucaaac

SEQ ID NO: 1588460 - RNA, 19 nt, Homo sapiens
gauccuaauugucaucauc

SEQ ID NO: 1588461 - RNA, 19 nt, Homo sapiens
gaaccgaaagcaaauaacu

SEQ ID NO: 1588462 - RNA, 19 nt, Homo sapiens
aaucugacuuucucaaaca

SEQ ID NO: 1588463 - RNA, 19 nt, Homo sapiens
gaacguccgcugguggaaa

SEQ ID NO: 1588464 - RNA, 19 nt, Homo sapiens
ggcaggauuugcuguaagu

SEQ ID NO: 1588465 - RNA, 19 nt, Homo sapiens
gcuguaagucuucaaguca

SEQ ID NO: 1588466 - RNA, 19 nt, Homo sapiens
ccuauagucuggagcucuu

SEQ ID NO: 1588467 - RNA, 19 nt, Homo sapiens
caaauaacugcacuaaggu

SEQ ID NO: 1588468 - RNA, 19 nt, Homo sapiens
gacagagaagguuaaucua

SEQ ID NO: 1588469 - RNA, 19 nt, Homo sapiens
acagauaacaacagucgaa

SEQ ID NO: 1588470 - RNA, 19 nt, Homo sapiens
uguaagucuucaagucauu

SEQ ID NO: 1588471 - RNA, 19 nt, Homo sapiens
aagcaaauaacugcacuaa

SEQ ID NO: 1588472 - RNA, 19 nt, Homo sapiens
gaagaacuggaaccgaaag

SEQ ID NO: 1588473 - RNA, 19 nt, Homo sapiens
uggcgcagcugcacuggau

SEQ ID NO: 1588474 - RNA, 19 nt, Homo sapiens
gcagcugcccaccaucuau

SEQ ID NO: 1588475 - RNA, 19 nt, Homo sapiens
cgaagaacuggaaccgaaa

SEQ ID NO: 1588476 - RNA, 19 nt, Homo sapiens
ggaaaacggcaaaguuguu

SEQ ID NO: 1588477 - RNA, 19 nt, Homo sapiens
ccaccuggacacagugaaa

SEQ ID NO: 1588478 - RNA, 19 nt, Homo sapiens
cuccugcccuggauccuaa

SEQ ID NO: 1588479 - RNA, 19 nt, Homo sapiens
guaagucuucaagucauuu

SEQ ID NO: 1588480 - RNA, 19 nt, Homo sapiens
ggagagcagacaggccuuu

SEQ ID NO: 1588481 - RNA, 19 nt, Homo sapiens
ccaacgagccaaaguacca

SEQ ID NO: 1588482 - RNA, 19 nt, Homo sapiens
acagagaagguuaaucuag

SEQ ID NO: 1588483 - RNA, 19 nt, Homo sapiens
gacuuucucaaacagauaa

SEQ ID NO: 1588484 - RNA, 19 nt, Homo sapiens
uagccaacgagccaaagua

SEQ ID NO: 1588485 - RNA, 19 nt, Homo sapiens
cagugaaaauugagguaua

SEQ ID NO: 1588486 - RNA, 19 nt, Homo sapiens
uccaaaagcuguauuuaag

SEQ ID NO: 1588487 - RNA, 19 nt, Homo sapiens
cgacauggcaggauuugcu

SEQ ID NO: 1588488 - RNA, 19 nt, Homo sapiens
gacgacaacaccuauaguc

SEQ ID NO: 1588489 - RNA, 19 nt, Homo sapiens
uaacugcacuaagguucuc

SEQ ID NO: 1588490 - RNA, 19 nt, Homo sapiens
uggaaccgaaagcaaauaa

SEQ ID NO: 1588491 - RNA, 19 nt, Homo sapiens
guauuuaagcgucguggau

SEQ ID NO: 1588492 - RNA, 19 nt, Homo sapiens
ugacgacgacaacaccuau

SEQ ID NO: 1588493 - RNA, 19 nt, Homo sapiens
ugacuuucucaaacagaua

SEQ ID NO: 1588494 - RNA, 19 nt, Homo sapiens
aggauuugcuguaagucuu

SEQ ID NO: 1588495 - RNA, 19 nt, Homo sapiens
gaaaacggcaaaguuguug

SEQ ID NO: 1588496 - RNA, 19 nt, Homo sapiens
gacgacgacaacaccuaua

SEQ ID NO: 1588497 - RNA, 19 nt, Homo sapiens
cauggcaggauuugcugua

SEQ ID NO: 1588498 - RNA, 19 nt, Homo sapiens
caucgacauggcaggauuu

SEQ ID NO: 1588499 - RNA, 19 nt, Homo sapiens
agccagggaugcaagaauc

SEQ ID NO: 1588500 - RNA, 19 nt, Homo sapiens
aaauaacugcacuaagguu

SEQ ID NO: 1588501 - RNA, 19 nt, Homo sapiens
ggauuugcuguaagucuuc

SEQ ID NO: 1588502 - RNA, 19 nt, Homo sapiens
ggacaaaguucuguauaua

SEQ ID NO: 1588503 - RNA, 19 nt, Homo sapiens
gaauacaucuuguuucuga

SEQ ID NO: 1588504 - RNA, 19 nt, Homo sapiens
ucacauagaucuagucuga

SEQ ID NO: 1588505 - RNA, 19 nt, Homo sapiens
uaaaguggcugguuaauuc

SEQ ID NO: 1588506 - RNA, 19 nt, Homo sapiens
gguaaaguguuaaggaaua

SEQ ID NO: 1588507 - RNA, 19 nt, Homo sapiens
ggaccuggcuacguaauua

SEQ ID NO: 1588508 - RNA, 19 nt, Homo sapiens
uaaaugaccucagaucuuu

SEQ ID NO: 1588509 - RNA, 19 nt, Homo sapiens
gaaagaacccucaaucaga

SEQ ID NO: 1588510 - RNA, 19 nt, Homo sapiens
gagagaaggugaaauaaag

SEQ ID NO: 1588511 - RNA, 19 nt, Homo sapiens
gcagaagccugucaucaga

SEQ ID NO: 1588512 - RNA, 19 nt, Homo sapiens
agacacagguugcagguua

SEQ ID NO: 1588513 - RNA, 19 nt, Homo sapiens
ggagaucaguaauuacaaa

SEQ ID NO: 1588514 - RNA, 19 nt, Homo sapiens
gaaacaggauaugcuuuaa

SEQ ID NO: 1588515 - RNA, 19 nt, Homo sapiens
caagagaggugcuaucaca

SEQ ID NO: 1588516 - RNA, 19 nt, Homo sapiens
guccaaugcuucacuguua

SEQ ID NO: 1588517 - RNA, 19 nt, Homo sapiens
ggucagcaguggaguuuaa

SEQ ID NO: 1588518 - RNA, 19 nt, Homo sapiens
caacaucucuugagugucu

SEQ ID NO: 1588519 - RNA, 19 nt, Homo sapiens
gaagcuaccugcuaugagu

SEQ ID NO: 1588520 - RNA, 19 nt, Homo sapiens
uaacugugcuuguugaaug

SEQ ID NO: 1588521 - RNA, 19 nt, Homo sapiens
gugaggcccuuauauaauu

SEQ ID NO: 1588522 - RNA, 19 nt, Homo sapiens
gaugcucaccucuauauua

SEQ ID NO: 1588523 - RNA, 19 nt, Homo sapiens
gcuaacaaguuugagcuua

SEQ ID NO: 1588524 - RNA, 19 nt, Homo sapiens
ggacauguacugagacaaa

SEQ ID NO: 1588525 - RNA, 19 nt, Homo sapiens
caaauaaacucaggcuguu

SEQ ID NO: 1588526 - RNA, 19 nt, Homo sapiens
gaagggauuuaaagggaaa

SEQ ID NO: 1588527 - RNA, 19 nt, Homo sapiens
gggaggaccuguuguguuc

SEQ ID NO: 1588528 - RNA, 19 nt, Homo sapiens
uuaagagccuucaauugua

SEQ ID NO: 1588529 - RNA, 19 nt, Homo sapiens
gcagugcaguuuaagcaaa

SEQ ID NO: 1588530 - RNA, 19 nt, Homo sapiens
gaacugaggcaucgcgaaa

SEQ ID NO: 1588531 - RNA, 19 nt, Homo sapiens
cuaaauacguccaccaaga

SEQ ID NO: 1588532 - RNA, 19 nt, Homo sapiens
ggaaauaguucaguaucug

SEQ ID NO: 1588533 - RNA, 19 nt, Homo sapiens
ucgaugagguuccauguuu

SEQ ID NO: 1588534 - RNA, 19 nt, Homo sapiens
cccaggagaucaguaauua

SEQ ID NO: 1588535 - RNA, 19 nt, Homo sapiens
acagagugauuguaguuua

SEQ ID NO: 1588536 - RNA, 19 nt, Homo sapiens
uauaacaccuuaacaguca

SEQ ID NO: 1588537 - RNA, 19 nt, Homo sapiens
caaaggagccacuucagaa

SEQ ID NO: 1588538 - RNA, 19 nt, Homo sapiens
gacaagaggcugagguuaa

SEQ ID NO: 1588539 - RNA, 19 nt, Homo sapiens
gaauggagaauacaucuug

SEQ ID NO: 1588540 - RNA, 19 nt, Homo sapiens
uaugucaugucuuccauua

SEQ ID NO: 1588541 - RNA, 19 nt, Homo sapiens
gcucaccucuauauuaguu

SEQ ID NO: 1588542 - RNA, 19 nt, Homo sapiens
caccaagccuguuugcuaa

SEQ ID NO: 1588543 - RNA, 19 nt, Homo sapiens
ccacuaaggugaccagagu

SEQ ID NO: 1588544 - RNA, 19 nt, Homo sapiens
acacuuuccucuucuauga

SEQ ID NO: 1588545 - RNA, 19 nt, Homo sapiens
caaaauaggugaggggaua

SEQ ID NO: 1588546 - RNA, 19 nt, Homo sapiens
cuaacaaguuugagcuuaa

SEQ ID NO: 1588547 - RNA, 19 nt, Homo sapiens
ggaaaccucagagcuauaa

SEQ ID NO: 1588548 - RNA, 19 nt, Homo sapiens
ggagaaaggaggagacaga

SEQ ID NO: 1588549 - RNA, 19 nt, Homo sapiens
gauaguaguggcucgauuu

SEQ ID NO: 1588550 - RNA, 19 nt, Homo sapiens
gaauuagguuucuuugaag

SEQ ID NO: 1588551 - RNA, 19 nt, Homo sapiens
ggaaguaugucaucaacac

SEQ ID NO: 1588552 - RNA, 19 nt, Homo sapiens
guucgaagccacuauguaa

SEQ ID NO: 1588553 - RNA, 19 nt, Homo sapiens
cagagugauuguaguuuaa

SEQ ID NO: 1588554 - RNA, 19 nt, Homo sapiens
ggauaugcuuuaagacaga

SEQ ID NO: 1588555 - RNA, 19 nt, Homo sapiens
caagggacuuugcuaacuu

SEQ ID NO: 1588556 - RNA, 19 nt, Homo sapiens
gaaacacucucugaagaag

SEQ ID NO: 1588557 - RNA, 19 nt, Homo sapiens
agaaacaggauaugcuuua

SEQ ID NO: 1588558 - RNA, 19 nt, Homo sapiens
acacaaugauuaacaggaa

SEQ ID NO: 1588559 - RNA, 19 nt, Homo sapiens
gcuauaaaguggagugaca

SEQ ID NO: 1588560 - RNA, 19 nt, Homo sapiens
gaaggagucgguugucuau

SEQ ID NO: 1588561 - RNA, 19 nt, Homo sapiens
gcaaaggagccacuucaga

SEQ ID NO: 1588562 - RNA, 19 nt, Homo sapiens
ggucaucucuccugugucu

SEQ ID NO: 1588563 - RNA, 19 nt, Homo sapiens
gcaguauucacaugcuuua

SEQ ID NO: 1588564 - RNA, 19 nt, Homo sapiens
ggaaugcccugaaacuacu

SEQ ID NO: 1588565 - RNA, 19 nt, Homo sapiens
ccagacagauagugaaaca

SEQ ID NO: 1588566 - RNA, 19 nt, Homo sapiens
aaacauaagcuaccugaau

SEQ ID NO: 1588567 - RNA, 19 nt, Homo sapiens
ugagguggauuuacugaga

SEQ ID NO: 1588568 - RNA, 19 nt, Homo sapiens
ucaccaagccuguuugcua

SEQ ID NO: 1588569 - RNA, 19 nt, Homo sapiens
agaauggucucaguguuaa

SEQ ID NO: 1588570 - RNA, 19 nt, Homo sapiens
uaagaauggucucaguguu

SEQ ID NO: 1588571 - RNA, 19 nt, Homo sapiens
ggacaagaggcugagguua

SEQ ID NO: 1588572 - RNA, 19 nt, Homo sapiens
gauaauacugucuaggaaa

SEQ ID NO: 1588573 - RNA, 19 nt, Homo sapiens
gagugaaacugcgauacaa

SEQ ID NO: 1588574 - RNA, 19 nt, Homo sapiens
gggcagcucuguccaaugc

SEQ ID NO: 1588575 - RNA, 19 nt, Homo sapiens
aagaauggucucaguguua

SEQ ID NO: 1588576 - RNA, 19 nt, Homo sapiens
acagggaaauaguucagua

SEQ ID NO: 1588577 - RNA, 19 nt, Homo sapiens
gaccagaaccgugaacuga

SEQ ID NO: 1588578 - RNA, 19 nt, Homo sapiens
ggaagagcauaguguuugg

SEQ ID NO: 1588579 - RNA, 19 nt, Homo sapiens
gugguaaaguguuaaggaa

SEQ ID NO: 1588580 - RNA, 19 nt, Homo sapiens
ugaggcccuuauauaauua

SEQ ID NO: 1588581 - RNA, 19 nt, Homo sapiens
caacagagagggagaaagg

SEQ ID NO: 1588582 - RNA, 19 nt, Homo sapiens
ggagaaucuuacagaguga

SEQ ID NO: 1588583 - RNA, 19 nt, Homo sapiens
uaagagccuucaauuguag

SEQ ID NO: 1588584 - RNA, 19 nt, Homo sapiens
ccagcucgcacuugacuua

SEQ ID NO: 1588585 - RNA, 19 nt, Homo sapiens
uaaauacguccaccaagaa

SEQ ID NO: 1588586 - RNA, 19 nt, Homo sapiens
ugaugaagcuaccugcuau

SEQ ID NO: 1588587 - RNA, 19 nt, Homo sapiens
gccgaugacuugcagaaug

SEQ ID NO: 1588588 - RNA, 19 nt, Homo sapiens
ucacaugcuuuaaacugaa

SEQ ID NO: 1588589 - RNA, 19 nt, Homo sapiens
uaacugaggcuuagaaagg

SEQ ID NO: 1588590 - RNA, 19 nt, Homo sapiens
aguuugagcuuaauaccua

SEQ ID NO: 1588591 - RNA, 19 nt, Homo sapiens
gaaacuacuguaucugaug

SEQ ID NO: 1588592 - RNA, 19 nt, Homo sapiens
ugaaguaacugaggcuuag

SEQ ID NO: 1588593 - RNA, 19 nt, Homo sapiens
aacaggauaugcuuuaaga

SEQ ID NO: 1588594 - RNA, 19 nt, Homo sapiens
uggacaaaguucuguauau

SEQ ID NO: 1588595 - RNA, 19 nt, Homo sapiens
aacauaagcuaccugaaug

SEQ ID NO: 1588596 - RNA, 19 nt, Homo sapiens
ucacaagggacuuugcuaa

SEQ ID NO: 1588597 - RNA, 19 nt, Homo sapiens
gggaaauaguucaguaucu

SEQ ID NO: 1588598 - RNA, 19 nt, Homo sapiens
cuuuaaaggugcagugaaa

SEQ ID NO: 1588599 - RNA, 19 nt, Homo sapiens
caaggcagguagaucacuu

SEQ ID NO: 1588600 - RNA, 19 nt, Homo sapiens
ccuguaaucccaacacuuu

SEQ ID NO: 1588601 - RNA, 19 nt, Homo sapiens
uaagggaaguuuagaugag

SEQ ID NO: 1588602 - RNA, 19 nt, Homo sapiens
guacgagccucuucauuua

SEQ ID NO: 1588603 - RNA, 19 nt, Homo sapiens
gaauaggcgugauugcuua

SEQ ID NO: 1588604 - RNA, 19 nt, Homo sapiens
gcaaaccagucaucauuaa

SEQ ID NO: 1588605 - RNA, 19 nt, Homo sapiens
gaaagucucggcagaauuu

SEQ ID NO: 1588606 - RNA, 19 nt, Homo sapiens
uaaaguggauuucucauga

SEQ ID NO: 1588607 - RNA, 19 nt, Homo sapiens
ucacugaacuuaaggauau

SEQ ID NO: 1588608 - RNA, 19 nt, Homo sapiens
ggacaacuucccaggauua

SEQ ID NO: 1588609 - RNA, 19 nt, Homo sapiens
cuacauaugugguggguuu

SEQ ID NO: 1588610 - RNA, 19 nt, Homo sapiens
gagcugugcuuggauaauu

SEQ ID NO: 1588611 - RNA, 19 nt, Homo sapiens
caacaucccuggcauuucu

SEQ ID NO: 1588612 - RNA, 19 nt, Homo sapiens
gcagaaggccuacauguuc

SEQ ID NO: 1588613 - RNA, 19 nt, Homo sapiens
gaacuuaaggauaucauug

SEQ ID NO: 1588614 - RNA, 19 nt, Homo sapiens
gaauguuacuugugaggaa

SEQ ID NO: 1588615 - RNA, 19 nt, Homo sapiens
ucaauaguguuaagcguuu

SEQ ID NO: 1588616 - RNA, 19 nt, Homo sapiens
ggaagaugcuguauuugag

SEQ ID NO: 1588617 - RNA, 19 nt, Homo sapiens
gaacaacacugaaaagaag

SEQ ID NO: 1588618 - RNA, 19 nt, Homo sapiens
gaaaggcuauguguauauc

SEQ ID NO: 1588619 - RNA, 19 nt, Homo sapiens
gcagacagaugggugaaug

SEQ ID NO: 1588620 - RNA, 19 nt, Homo sapiens
gcagaccaguuuaacauca

SEQ ID NO: 1588621 - RNA, 19 nt, Homo sapiens
ugacaguccucggcaauuu

SEQ ID NO: 1588622 - RNA, 19 nt, Homo sapiens
ucagagcugugcuuggaua

SEQ ID NO: 1588623 - RNA, 19 nt, Homo sapiens
aaacacugcugaacguuau

SEQ ID NO: 1588624 - RNA, 19 nt, Homo sapiens
ggaaacgagugccuguuca

SEQ ID NO: 1588625 - RNA, 19 nt, Homo sapiens
gaacagaggagugaugcaa

SEQ ID NO: 1588626 - RNA, 19 nt, Homo sapiens
uguaugaccucaacaugaa

SEQ ID NO: 1588627 - RNA, 19 nt, Homo sapiens
ggaauaggcgugauugcuu

SEQ ID NO: 1588628 - RNA, 19 nt, Homo sapiens
cauaagaacauccucugua

SEQ ID NO: 1588629 - RNA, 19 nt, Homo sapiens
gauuagcacugcgagauga

SEQ ID NO: 1588630 - RNA, 19 nt, Homo sapiens
gggugaauguuacuuguga

SEQ ID NO: 1588631 - RNA, 19 nt, Homo sapiens
aagaugagcucaaugucaa

SEQ ID NO: 1588632 - RNA, 19 nt, Homo sapiens
gcacaacuuugaggagaug

SEQ ID NO: 1588633 - RNA, 19 nt, Homo sapiens
ggugguggaugaccucuug

SEQ ID NO: 1588634 - RNA, 19 nt, Homo sapiens
gggaaggucuacauaugug

SEQ ID NO: 1588635 - RNA, 19 nt, Homo sapiens
acaaguggcuggaacaaca

SEQ ID NO: 1588636 - RNA, 19 nt, Homo sapiens
uagcugcaguuccuacuuu

SEQ ID NO: 1588637 - RNA, 19 nt, Homo sapiens
guggguggcuuuaaugguu

SEQ ID NO: 1588638 - RNA, 19 nt, Homo sapiens
gcaagcgccacaacacuuu

SEQ ID NO: 1588639 - RNA, 19 nt, Homo sapiens
uaaacacugcugaacguua

SEQ ID NO: 1588640 - RNA, 19 nt, Homo sapiens
uaagaugaaugacuauguc

SEQ ID NO: 1588641 - RNA, 19 nt, Homo sapiens
aagcagcacauuucaauuu

SEQ ID NO: 1588642 - RNA, 19 nt, Homo sapiens
ugagugcgauggccuguga

SEQ ID NO: 1588643 - RNA, 19 nt, Homo sapiens
ucaacgagcuuagacuaga

SEQ ID NO: 1588644 - RNA, 19 nt, Homo sapiens
uggccaauguugaggaaua

SEQ ID NO: 1588645 - RNA, 19 nt, Homo sapiens
uggaugaccucuuguuugu

SEQ ID NO: 1588646 - RNA, 19 nt, Homo sapiens
gcccugagcugaggcagaa

SEQ ID NO: 1588647 - RNA, 19 nt, Homo sapiens
cgugauugcuuauggagaa

SEQ ID NO: 1588648 - RNA, 19 nt, Homo sapiens
gcgaguuccucaagucaga

SEQ ID NO: 1588649 - RNA, 19 nt, Homo sapiens
uguacgagccucuucauuu

SEQ ID NO: 1588650 - RNA, 19 nt, Homo sapiens
ugaggaauaugcagcuaga

SEQ ID NO: 1588651 - RNA, 19 nt, Homo sapiens
guucacagcagaaguguau

SEQ ID NO: 1588652 - RNA, 19 nt, Homo sapiens
gacagaugggugaauguua

SEQ ID NO: 1588653 - RNA, 19 nt, Homo sapiens
ccucuucauuuagcuaaua

SEQ ID NO: 1588654 - RNA, 19 nt, Homo sapiens
ugauggagcuaaucgacuu

SEQ ID NO: 1588655 - RNA, 19 nt, Homo sapiens
gcugaguacuucaugaaca

SEQ ID NO: 1588656 - RNA, 19 nt, Homo sapiens
cagaaggccuacauguuca

SEQ ID NO: 1588657 - RNA, 19 nt, Homo sapiens
ugaagcuaaucauugagua

SEQ ID NO: 1588658 - RNA, 19 nt, Homo sapiens
ucacagcagaaguguauaa

SEQ ID NO: 1588659 - RNA, 19 nt, Homo sapiens
gaagcuaaucauugaguau

SEQ ID NO: 1588660 - RNA, 19 nt, Homo sapiens
auaagaacauccucuguag

SEQ ID NO: 1588661 - RNA, 19 nt, Homo sapiens
caucauuaaugcccuaaag

SEQ ID NO: 1588662 - RNA, 19 nt, Homo sapiens
gacaaguacccuaccugua

SEQ ID NO: 1588663 - RNA, 19 nt, Homo sapiens
gcacugcgagaugaaguaa

SEQ ID NO: 1588664 - RNA, 19 nt, Homo sapiens
gagcugcuguguaguacca

SEQ ID NO: 1588665 - RNA, 19 nt, Homo sapiens
gcuaacacuuggcgcacaa

SEQ ID NO: 1588666 - RNA, 19 nt, Homo sapiens
ccugugagaucuucaacga

SEQ ID NO: 1588667 - RNA, 19 nt, Homo sapiens
ccgaugcacuccagacguu

SEQ ID NO: 1588668 - RNA, 19 nt, Homo sapiens
uugaaaggcuauguguaua

SEQ ID NO: 1588669 - RNA, 19 nt, Homo sapiens
gccauccucuuugcaauug

SEQ ID NO: 1588670 - RNA, 19 nt, Homo sapiens
ucaaagacagugaggaaug

SEQ ID NO: 1588671 - RNA, 19 nt, Homo sapiens
ggauaucauugagaaagau

SEQ ID NO: 1588672 - RNA, 19 nt, Homo sapiens
gugaaagucucggcagaau

SEQ ID NO: 1588673 - RNA, 19 nt, Homo sapiens
guucauacugcacaacuuu

SEQ ID NO: 1588674 - RNA, 19 nt, Homo sapiens
agaaagaugagcucaaugu

SEQ ID NO: 1588675 - RNA, 19 nt, Homo sapiens
guaaguucacggacuacua

SEQ ID NO: 1588676 - RNA, 19 nt, Homo sapiens
ccaccaccuuuaauguuga

SEQ ID NO: 1588677 - RNA, 19 nt, Homo sapiens
gaaaagaagguauacaaca

SEQ ID NO: 1588678 - RNA, 19 nt, Homo sapiens
ccuuuaauguugagugcua

SEQ ID NO: 1588679 - RNA, 19 nt, Homo sapiens
agaccacgcuugcccuaug

SEQ ID NO: 1588680 - RNA, 19 nt, Homo sapiens
caaagacagugaggaaugc

SEQ ID NO: 1588681 - RNA, 19 nt, Homo sapiens
ucuguaaguucacggacua

SEQ ID NO: 1588682 - RNA, 19 nt, Homo sapiens
agucagagcugugcuugga

SEQ ID NO: 1588683 - RNA, 19 nt, Homo sapiens
caacuucccaggauuagca

SEQ ID NO: 1588684 - RNA, 19 nt, Homo sapiens
guugagugcuaugaugaaa

SEQ ID NO: 1588685 - RNA, 19 nt, Homo sapiens
aaaccagucaucauuaaug

SEQ ID NO: 1588686 - RNA, 19 nt, Homo sapiens
ggcagaaggccuacauguu

SEQ ID NO: 1588687 - RNA, 19 nt, Homo sapiens
gugguggguuuaauggaaa

SEQ ID NO: 1588688 - RNA, 19 nt, Homo sapiens
ugaaaggcuauguguauau

SEQ ID NO: 1588689 - RNA, 19 nt, Homo sapiens
acagaugggugaauguuac

SEQ ID NO: 1588690 - RNA, 19 nt, Homo sapiens
gaaagaugagcucaauguc

SEQ ID NO: 1588691 - RNA, 19 nt, Homo sapiens
uugaggagauggugaaagu

SEQ ID NO: 1588692 - RNA, 19 nt, Homo sapiens
gaaggccuacauguucaua

SEQ ID NO: 1588693 - RNA, 19 nt, Homo sapiens
uggcauuucuccugacaug

SEQ ID NO: 1588694 - RNA, 19 nt, Homo sapiens
ggccaauguugaggaauau

SEQ ID NO: 1588695 - RNA, 19 nt, Homo sapiens
guuaugagccagagaccaa

SEQ ID NO: 1588696 - RNA, 19 nt, Homo sapiens
aggaagaugcuguauuuga

SEQ ID NO: 1588697 - RNA, 19 nt, Homo sapiens
aaagaugagcucaauguca

SEQ ID NO: 1588698 - RNA, 19 nt, Homo sapiens
gcauuucuccugacaugau

SEQ ID NO: 1588699 - RNA, 19 nt, Homo sapiens
aaagaccgaugagugguau

SEQ ID NO: 1588700 - RNA, 19 nt, Homo sapiens
gguggaugaccucuuguuu

SEQ ID NO: 1588701 - RNA, 19 nt, Homo sapiens
ugugguggguuuaauggaa

SEQ ID NO: 1588702 - RNA, 19 nt, Homo sapiens
gcacuucccuccucuguga

SEQ ID NO: 1588703 - RNA, 19 nt, Homo sapiens
agacauagcugcauugaau

SEQ ID NO: 1588704 - RNA, 19 nt, Homo sapiens
ugaaagacauagcugcauu

SEQ ID NO: 1588705 - RNA, 19 nt, Homo sapiens
gcacccgccugggaacuua

SEQ ID NO: 1588706 - RNA, 19 nt, Homo sapiens
ucagacaccuuggauguuu

SEQ ID NO: 1588707 - RNA, 19 nt, Homo sapiens
ccaaggaccucaugcucaa

SEQ ID NO: 1588708 - RNA, 19 nt, Homo sapiens
ggaggcagaaguaugauuu

SEQ ID NO: 1588709 - RNA, 19 nt, Homo sapiens
gaacaggagguaccacuuc

SEQ ID NO: 1588710 - RNA, 19 nt, Homo sapiens
ggugcgagcugaccugaga

SEQ ID NO: 1588711 - RNA, 19 nt, Homo sapiens
ccuuggauguuuauucuaa

SEQ ID NO: 1588712 - RNA, 19 nt, Homo sapiens
agaagggccugcacagcua

SEQ ID NO: 1588713 - RNA, 19 nt, Homo sapiens
gaaagacauagcugcauug

SEQ ID NO: 1588714 - RNA, 19 nt, Homo sapiens
cagacaccuuggauguuua

SEQ ID NO: 1588715 - RNA, 19 nt, Homo sapiens
ugaggaggcagaaguauga

SEQ ID NO: 1588716 - RNA, 19 nt, Homo sapiens
cacccucaauccuucaaua

SEQ ID NO: 1588717 - RNA, 19 nt, Homo sapiens
gcacugaggaggcagaagu

SEQ ID NO: 1588718 - RNA, 19 nt, Homo sapiens
gggaccgacuggccaugua

SEQ ID NO: 1588719 - RNA, 19 nt, Homo sapiens
cccagaagaugcucaagga

SEQ ID NO: 1588720 - RNA, 19 nt, Homo sapiens
gcaaaauugucucaucuuc

SEQ ID NO: 1588721 - RNA, 19 nt, Homo sapiens
ugugaggacuccaagagaa

SEQ ID NO: 1588722 - RNA, 19 nt, Homo sapiens
guacaaggcggaggugaug

SEQ ID NO: 1588723 - RNA, 19 nt, Homo sapiens
caccuuggauguuuauucu

SEQ ID NO: 1588724 - RNA, 19 nt, Homo sapiens
ccucaauccuucaauaaaa

SEQ ID NO: 1588725 - RNA, 19 nt, Homo sapiens
cggcuuggcccucugguuu

SEQ ID NO: 1588726 - RNA, 19 nt, Homo sapiens
ucauggcggucgucuggaa

SEQ ID NO: 1588727 - RNA, 19 nt, Homo sapiens
cuacagggccgaguacgaa

SEQ ID NO: 1588728 - RNA, 19 nt, Homo sapiens
caacuccagcuccgucuau

SEQ ID NO: 1588729 - RNA, 19 nt, Homo sapiens
auuccacgcuggguuguua

SEQ ID NO: 1588730 - RNA, 19 nt, Homo sapiens
ccugggaacuuacuacaac

SEQ ID NO: 1588731 - RNA, 19 nt, Homo sapiens
gcuuggcccucugguuuga

SEQ ID NO: 1588732 - RNA, 19 nt, Homo sapiens
ggaccgacuggccauguau

SEQ ID NO: 1588733 - RNA, 19 nt, Homo sapiens
guuguuaccgcuacagcua

SEQ ID NO: 1588734 - RNA, 19 nt, Homo sapiens
gcagugaaaccgccaaagc

SEQ ID NO: 1588735 - RNA, 19 nt, Homo sapiens
gguauuuccuaggguacaa

SEQ ID NO: 1588736 - RNA, 19 nt, Homo sapiens
gugaggacuccaagagaaa

SEQ ID NO: 1588737 - RNA, 19 nt, Homo sapiens
ucaccugcuucuucugguu

SEQ ID NO: 1588738 - RNA, 19 nt, Homo sapiens
gggugcuacucugguauuu

SEQ ID NO: 1588739 - RNA, 19 nt, Homo sapiens
ucagacacguuuggucauc

SEQ ID NO: 1588740 - RNA, 19 nt, Homo sapiens
ccagcuccgucuauuccuu

SEQ ID NO: 1588741 - RNA, 19 nt, Homo sapiens
gcacccacuugcagucacu

SEQ ID NO: 1588742 - RNA, 19 nt, Homo sapiens
gacauagcugcauugaauu

SEQ ID NO: 1588743 - RNA, 19 nt, Homo sapiens
ggaagccagugugaaagac

SEQ ID NO: 1588744 - RNA, 19 nt, Homo sapiens
cgccaaagcccagaagaug

SEQ ID NO: 1588745 - RNA, 19 nt, Homo sapiens
gugcuacucugguauuucc

SEQ ID NO: 1588746 - RNA, 19 nt, Homo sapiens
cggaggugauggcgaggaa

SEQ ID NO: 1588747 - RNA, 19 nt, Homo sapiens
ccucugguuugaugccuau

SEQ ID NO: 1588748 - RNA, 19 nt, Homo sapiens
cgccugauguuguuacucu

SEQ ID NO: 1588749 - RNA, 19 nt, Homo sapiens
gaagccagugugaaagaca

SEQ ID NO: 1588750 - RNA, 19 nt, Homo sapiens
gaggcagaaguaugauuug

SEQ ID NO: 1588751 - RNA, 19 nt, Homo sapiens
ggucaucagacaccuugga

SEQ ID NO: 1588752 - RNA, 19 nt, Homo sapiens
cagcuccgucuauuccuuu

SEQ ID NO: 1588753 - RNA, 19 nt, Homo sapiens
aaagacauagcugcauuga

SEQ ID NO: 1588754 - RNA, 19 nt, Homo sapiens
ccacuucucccaggaucuu

SEQ ID NO: 1588755 - RNA, 19 nt, Homo sapiens
gcuacucugguauuuccua

SEQ ID NO: 1588756 - RNA, 19 nt, Homo sapiens
cagacacguuuggucauca

SEQ ID NO: 1588757 - RNA, 19 nt, Homo sapiens
uguacucaaucgccacuuc

SEQ ID NO: 1588758 - RNA, 19 nt, Homo sapiens
uuccaggccugugaaguga

SEQ ID NO: 1588759 - RNA, 19 nt, Homo sapiens
gguacaaggcggaggugau

SEQ ID NO: 1588760 - RNA, 19 nt, Homo sapiens
gagaauggauuuauagaga

SEQ ID NO: 1588761 - RNA, 19 nt, Homo sapiens
ggaaauccguaaucacuuu

SEQ ID NO: 1588762 - RNA, 19 nt, Homo sapiens
guuccgagcuucucuauaa

SEQ ID NO: 1588763 - RNA, 19 nt, Homo sapiens
gcacuucucccuuuccuua

SEQ ID NO: 1588764 - RNA, 19 nt, Homo sapiens
gaaaacagcuugucaauac

SEQ ID NO: 1588765 - RNA, 19 nt, Homo sapiens
ggaauucauuuguucauug

SEQ ID NO: 1588766 - RNA, 19 nt, Homo sapiens
gcagagagcgugagaaguu

SEQ ID NO: 1588767 - RNA, 19 nt, Homo sapiens
caacacagcugccguuucu

SEQ ID NO: 1588768 - RNA, 19 nt, Homo sapiens
gcaaagcuguauugaaagu

SEQ ID NO: 1588769 - RNA, 19 nt, Homo sapiens
ggaacuggcuccuuaccuu

SEQ ID NO: 1588770 - RNA, 19 nt, Homo sapiens
augcaaagcuguauugaaa

SEQ ID NO: 1588771 - RNA, 19 nt, Homo sapiens
guaugaaggucaaaugaga

SEQ ID NO: 1588772 - RNA, 19 nt, Homo sapiens
gaaccaccaucaacuuuag

SEQ ID NO: 1588773 - RNA, 19 nt, Homo sapiens
uaaaugaagucacacaaca

SEQ ID NO: 1588774 - RNA, 19 nt, Homo sapiens
gaaggaggccacaaaccua

SEQ ID NO: 1588775 - RNA, 19 nt, Homo sapiens
guaaucacuuucagucuau

SEQ ID NO: 1588776 - RNA, 19 nt, Homo sapiens
gaacaucaucuaaauccaa

SEQ ID NO: 1588777 - RNA, 19 nt, Homo sapiens
gugacuggcuucuaucaaa

SEQ ID NO: 1588778 - RNA, 19 nt, Homo sapiens
agaggagaauggauuuaua

SEQ ID NO: 1588779 - RNA, 19 nt, Homo sapiens
cguaaucacuuucagucua

SEQ ID NO: 1588780 - RNA, 19 nt, Homo sapiens
ggaagccacugagucugua

SEQ ID NO: 1588781 - RNA, 19 nt, Homo sapiens
gaaacuaccuacccaucag

SEQ ID NO: 1588782 - RNA, 19 nt, Homo sapiens
gcaagggguuuguauauau

SEQ ID NO: 1588783 - RNA, 19 nt, Homo sapiens
ggaggaaggaggccacaaa

SEQ ID NO: 1588784 - RNA, 19 nt, Homo sapiens
gcagggacccgauucuuuc

SEQ ID NO: 1588785 - RNA, 19 nt, Homo sapiens
gucuaaaucuagcauugua

SEQ ID NO: 1588786 - RNA, 19 nt, Homo sapiens
gaggaauggcugcauguuu

SEQ ID NO: 1588787 - RNA, 19 nt, Homo sapiens
gcccaucuauuucaagugu

SEQ ID NO: 1588788 - RNA, 19 nt, Homo sapiens
gggaauucauuuguucauu

SEQ ID NO: 1588789 - RNA, 19 nt, Homo sapiens
gucuggaacuggcuccuua

SEQ ID NO: 1588790 - RNA, 19 nt, Homo sapiens
gcagagagagagaggaaug

SEQ ID NO: 1588791 - RNA, 19 nt, Homo sapiens
gcaagguucauuuauguuc

SEQ ID NO: 1588792 - RNA, 19 nt, Homo sapiens
gccagcaccuugacuuuag

SEQ ID NO: 1588793 - RNA, 19 nt, Homo sapiens
ggucucaauuucuuuaucu

SEQ ID NO: 1588794 - RNA, 19 nt, Homo sapiens
aaauccaacuugaccauug

SEQ ID NO: 1588795 - RNA, 19 nt, Homo sapiens
ggaguacuuugccuugcuu

SEQ ID NO: 1588796 - RNA, 19 nt, Homo sapiens
acacaacacugggucuuau

SEQ ID NO: 1588797 - RNA, 19 nt, Homo sapiens
gaaggggaauucauuuguu

SEQ ID NO: 1588798 - RNA, 19 nt, Homo sapiens
ggccacacuugcuagauug

SEQ ID NO: 1588799 - RNA, 19 nt, Homo sapiens
gagaggagaauggauuuau

SEQ ID NO: 1588800 - RNA, 19 nt, Homo sapiens
auucaucacuccagaagaa

SEQ ID NO: 1588801 - RNA, 19 nt, Homo sapiens
gaacuauaagacagaaaug

SEQ ID NO: 1588802 - RNA, 19 nt, Homo sapiens
gaaggucaaaugagagaau

SEQ ID NO: 1588803 - RNA, 19 nt, Homo sapiens
ggagaggagaauggauuua

SEQ ID NO: 1588804 - RNA, 19 nt, Homo sapiens
caagguucauuuauguuca

SEQ ID NO: 1588805 - RNA, 19 nt, Homo sapiens
gaguaugaaggucaaauga

SEQ ID NO: 1588806 - RNA, 19 nt, Homo sapiens
gaauggauuuauagagaac

SEQ ID NO: 1588807 - RNA, 19 nt, Homo sapiens
gaggagaauggauuuauag

SEQ ID NO: 1588808 - RNA, 19 nt, Homo sapiens
gugaugagaucgggaaagu

SEQ ID NO: 1588809 - RNA, 19 nt, Homo sapiens
ggucuuggcuggguugaag

SEQ ID NO: 1588810 - RNA, 19 nt, Homo sapiens
gaaauggaagccacugagu

SEQ ID NO: 1588811 - RNA, 19 nt, Homo sapiens
ggcagggacccgauucuuu

SEQ ID NO: 1588812 - RNA, 19 nt, Homo sapiens
aaagcuguauugaaaguuc

SEQ ID NO: 1588813 - RNA, 19 nt, Homo sapiens
ccuaggaaauccguaauca

SEQ ID NO: 1588814 - RNA, 19 nt, Homo sapiens
gcaaucagaacuauaagac

SEQ ID NO: 1588815 - RNA, 19 nt, Homo sapiens
ucaucuaaauccaacuuga

SEQ ID NO: 1588816 - RNA, 19 nt, Homo sapiens
cuauccagcccaucuauuu

SEQ ID NO: 1588817 - RNA, 19 nt, Homo sapiens
uugcaagguucauuuaugu

SEQ ID NO: 1588818 - RNA, 19 nt, Homo sapiens
uuaugugacuggcuucuau

SEQ ID NO: 1588819 - RNA, 19 nt, Homo sapiens
ggauuugccuauucuagac

SEQ ID NO: 1588820 - RNA, 19 nt, Homo sapiens
ggaaggaggccacaaaccu

SEQ ID NO: 1588821 - RNA, 19 nt, Homo sapiens
aaauauuucuccacagagu

SEQ ID NO: 1588822 - RNA, 19 nt, Homo sapiens
gagaacaucaucuaaaucc

SEQ ID NO: 1588823 - RNA, 19 nt, Homo sapiens
agaaccaccaucaacuuua

SEQ ID NO: 1588824 - RNA, 19 nt, Homo sapiens
uggccacacuugcuagauu

SEQ ID NO: 1588825 - RNA, 19 nt, Homo sapiens
gaaguucugcagauguaug

SEQ ID NO: 1588826 - RNA, 19 nt, Homo sapiens
gggagaggagaauggauuu

SEQ ID NO: 1588827 - RNA, 19 nt, Homo sapiens
ggguggcucuggcaggaaa

SEQ ID NO: 1588828 - RNA, 19 nt, Homo sapiens
guauauauucacagaguug

SEQ ID NO: 1588829 - RNA, 19 nt, Homo sapiens
aaggucaaaugagagaaua

SEQ ID NO: 1588830 - RNA, 19 nt, Homo sapiens
uagucuaaaucuagcauug

SEQ ID NO: 1588831 - RNA, 19 nt, Homo sapiens
ccugcaaccuccugauaug

SEQ ID NO: 1588832 - RNA, 19 nt, Homo sapiens
aaagaaccaccaucaacuu

SEQ ID NO: 1588833 - RNA, 19 nt, Homo sapiens
uaaagaaccaccaucaacu

SEQ ID NO: 1588834 - RNA, 19 nt, Homo sapiens
ggagaauggauuuauagag

SEQ ID NO: 1588835 - RNA, 19 nt, Homo sapiens
ucagaacuauaagacagaa

SEQ ID NO: 1588836 - RNA, 19 nt, Homo sapiens
ggauuuauagagaacauca

SEQ ID NO: 1588837 - RNA, 19 nt, Homo sapiens
cagcagagagagagaggaa

SEQ ID NO: 1588838 - RNA, 19 nt, Homo sapiens
ucuauggauuugccuauuc

SEQ ID NO: 1588839 - RNA, 19 nt, Homo sapiens
gaugcacgaugggcaagga

SEQ ID NO: 1588840 - RNA, 19 nt, Homo sapiens
gcuuggagcugcacaaacc

SEQ ID NO: 1588841 - RNA, 19 nt, Homo sapiens
ugauauggccauugcaguu

SEQ ID NO: 1588842 - RNA, 19 nt, Homo sapiens
ugacuggcuucuaucaaag

SEQ ID NO: 1588843 - RNA, 19 nt, Homo sapiens
aacacugggucuuauguga

SEQ ID NO: 1588844 - RNA, 19 nt, Homo sapiens
gggacccgauucuuuccuu

SEQ ID NO: 1588845 - RNA, 19 nt, Homo sapiens
aggaauggcugcauguuuu

SEQ ID NO: 1588846 - RNA, 19 nt, Homo sapiens
aagaaccaccaucaacuuu

SEQ ID NO: 1588847 - RNA, 19 nt, Homo sapiens
cacacuugcuagauugcua

SEQ ID NO: 1588848 - RNA, 19 nt, Homo sapiens
caagggguuuguauauauu

SEQ ID NO: 1588849 - RNA, 19 nt, Homo sapiens
cagcagcaauagaaaacua

SEQ ID NO: 1588850 - RNA, 19 nt, Homo sapiens
ggaggccacaaaccuagaa

SEQ ID NO: 1588851 - RNA, 19 nt, Homo sapiens
uauugaaaguuccgagcuu

SEQ ID NO: 1588852 - RNA, 19 nt, Homo sapiens
cagcccaucuauuucaagu

SEQ ID NO: 1588853 - RNA, 19 nt, Homo sapiens
gauauggccauugcaguuc

SEQ ID NO: 1588854 - RNA, 19 nt, Homo sapiens
ccauguccaucacacaaca

SEQ ID NO: 1588855 - RNA, 19 nt, Homo sapiens
gaaaguuccgagcuucucu

SEQ ID NO: 1588856 - RNA, 19 nt, Homo sapiens
guacuuugccuugcuuaca

SEQ ID NO: 1588857 - RNA, 19 nt, Homo sapiens
gagaggaauggcugcaugu

SEQ ID NO: 1588858 - RNA, 19 nt, Homo sapiens
acacagcugccguuucuuc

SEQ ID NO: 1588859 - RNA, 19 nt, Homo sapiens
uuugcaagguucauuuaug

SEQ ID NO: 1588860 - RNA, 19 nt, Homo sapiens
gaaaggaggccuagcaugu

SEQ ID NO: 1588861 - RNA, 19 nt, Homo sapiens
gagagucaauucacaaugu

SEQ ID NO: 1588862 - RNA, 19 nt, Homo sapiens
gaauagcucauuacaggua

SEQ ID NO: 1588863 - RNA, 19 nt, Homo sapiens
gcacuggucuugguguuug

SEQ ID NO: 1588864 - RNA, 19 nt, Homo sapiens
ugacucaauugcugauaua

SEQ ID NO: 1588865 - RNA, 19 nt, Homo sapiens
ggaggcauauacacagauu

SEQ ID NO: 1588866 - RNA, 19 nt, Homo sapiens
ggucgcagcuaaacacgaa

SEQ ID NO: 1588867 - RNA, 19 nt, Homo sapiens
gauaaaguauucucucacu

SEQ ID NO: 1588868 - RNA, 19 nt, Homo sapiens
cagcagauacuaacagaaa

SEQ ID NO: 1588869 - RNA, 19 nt, Homo sapiens
aaacuaaaguccagcagau

SEQ ID NO: 1588870 - RNA, 19 nt, Homo sapiens
gaaauuccaagcucauuca

SEQ ID NO: 1588871 - RNA, 19 nt, Homo sapiens
ugauauagguaaagaaugg

SEQ ID NO: 1588872 - RNA, 19 nt, Homo sapiens
guaccaccguuauaaguuc

SEQ ID NO: 1588873 - RNA, 19 nt, Homo sapiens
ugaauuggcagaccgcaua

SEQ ID NO: 1588874 - RNA, 19 nt, Homo sapiens
ucacuugucacuugaauug

SEQ ID NO: 1588875 - RNA, 19 nt, Homo sapiens
auuccaagcucauucagua

SEQ ID NO: 1588876 - RNA, 19 nt, Homo sapiens
uguuugcccuuuauuauga

SEQ ID NO: 1588877 - RNA, 19 nt, Homo sapiens
ccaagcucauucaguagaa

SEQ ID NO: 1588878 - RNA, 19 nt, Homo sapiens
gaagaaauuccaagcucau

SEQ ID NO: 1588879 - RNA, 19 nt, Homo sapiens
gguguuugcccuuuauuau

SEQ ID NO: 1588880 - RNA, 19 nt, Homo sapiens
gagaacagagcgagaugga

SEQ ID NO: 1588881 - RNA, 19 nt, Homo sapiens
guuagcagucaaagaauuu

SEQ ID NO: 1588882 - RNA, 19 nt, Homo sapiens
aguauucucucacuuguca

SEQ ID NO: 1588883 - RNA, 19 nt, Homo sapiens
gcugauauagguaaagaau

SEQ ID NO: 1588884 - RNA, 19 nt, Homo sapiens
ggccuagcauguucgagaa

SEQ ID NO: 1588885 - RNA, 19 nt, Homo sapiens
uuacagguacuaaggauug

SEQ ID NO: 1588886 - RNA, 19 nt, Homo sapiens
gcagaccgcauacuguuag

SEQ ID NO: 1588887 - RNA, 19 nt, Homo sapiens
aaagacuggccaagcaaua

SEQ ID NO: 1588888 - RNA, 19 nt, Homo sapiens
gauacuaacagaaagucuu

SEQ ID NO: 1588889 - RNA, 19 nt, Homo sapiens
caauucacaauguucagua

SEQ ID NO: 1588890 - RNA, 19 nt, Homo sapiens
gggacuggcuagggcguuu

SEQ ID NO: 1588891 - RNA, 19 nt, Homo sapiens
uaagagaaagacugagaga

SEQ ID NO: 1588892 - RNA, 19 nt, Homo sapiens
gguaccaccguuauaaguu

SEQ ID NO: 1588893 - RNA, 19 nt, Homo sapiens
uguuagcagucaaagaauu

SEQ ID NO: 1588894 - RNA, 19 nt, Homo sapiens
gcagauacuaacagaaagu

SEQ ID NO: 1588895 - RNA, 19 nt, Homo sapiens
caagcucauucaguagaaa

SEQ ID NO: 1588896 - RNA, 19 nt, Homo sapiens
gagagagucaauucacaau

SEQ ID NO: 1588897 - RNA, 19 nt, Homo sapiens
agagaaagacugagagagu

SEQ ID NO: 1588898 - RNA, 19 nt, Homo sapiens
ggcagaccgcauacuguua

SEQ ID NO: 1588899 - RNA, 19 nt, Homo sapiens
caauugcugauauagguaa

SEQ ID NO: 1588900 - RNA, 19 nt, Homo sapiens
aaagaaaggaggccuagca

SEQ ID NO: 1588901 - RNA, 19 nt, Homo sapiens
ggugacgccuaggaaagaa

SEQ ID NO: 1588902 - RNA, 19 nt, Homo sapiens
agagucaauucacaauguu

SEQ ID NO: 1588903 - RNA, 19 nt, Homo sapiens
acuaaggauuguuuacuuc

SEQ ID NO: 1588904 - RNA, 19 nt, Homo sapiens
uaaaguccagcagauacua

SEQ ID NO: 1588905 - RNA, 19 nt, Homo sapiens
cauuacagguacuaaggau

SEQ ID NO: 1588906 - RNA, 19 nt, Homo sapiens
aaggaggccuagcauguuc

SEQ ID NO: 1588907 - RNA, 19 nt, Homo sapiens
ucaaaagacuggccaagca

SEQ ID NO: 1588908 - RNA, 19 nt, Homo sapiens
cucauucaguagaaacuaa

SEQ ID NO: 1588909 - RNA, 19 nt, Homo sapiens
uggagccauugaagaaauu

SEQ ID NO: 1588910 - RNA, 19 nt, Homo sapiens
ugagagagucaauucacaa

SEQ ID NO: 1588911 - RNA, 19 nt, Homo sapiens
cagguacuaaggauuguuu

SEQ ID NO: 1588912 - RNA, 19 nt, Homo sapiens
cgagaaggaggcauauaca

SEQ ID NO: 1588913 - RNA, 19 nt, Homo sapiens
aaaggaggccuagcauguu

SEQ ID NO: 1588914 - RNA, 19 nt, Homo sapiens
cucaauugcugauauaggu

SEQ ID NO: 1588915 - RNA, 19 nt, Homo sapiens
agaaggaggcauauacaca

SEQ ID NO: 1588916 - RNA, 19 nt, Homo sapiens
aaggaggcauauacacaga

SEQ ID NO: 1588917 - RNA, 19 nt, Homo sapiens
guacuaaggauuguuuacu

SEQ ID NO: 1588918 - RNA, 19 nt, Homo sapiens
ucucucacuugucacuuga

SEQ ID NO: 1588919 - RNA, 19 nt, Homo sapiens
agacuggccaagcaauaaa

SEQ ID NO: 1588920 - RNA, 19 nt, Homo sapiens
cuacguggcacuggucuug

SEQ ID NO: 1588921 - RNA, 19 nt, Homo sapiens
uccagcagauacuaacaga

SEQ ID NO: 1588922 - RNA, 19 nt, Homo sapiens
aaaguccagcagauacuaa

SEQ ID NO: 1588923 - RNA, 19 nt, Homo sapiens
gcucauucaguagaaacua

SEQ ID NO: 1588924 - RNA, 19 nt, Homo sapiens
aagacuggccaagcaauaa

SEQ ID NO: 1588925 - RNA, 19 nt, Homo sapiens
uggcagaccgcauacuguu

SEQ ID NO: 1588926 - RNA, 19 nt, Homo sapiens
ucaauugcugauauaggua

SEQ ID NO: 1588927 - RNA, 19 nt, Homo sapiens
ccaccguuauaaguucauu

SEQ ID NO: 1588928 - RNA, 19 nt, Homo sapiens
uucacaauguucaguaugu

SEQ ID NO: 1588929 - RNA, 19 nt, Homo sapiens
cugagagagucaauucaca

SEQ ID NO: 1588930 - RNA, 19 nt, Homo sapiens
uugcugauauagguaaaga

SEQ ID NO: 1588931 - RNA, 19 nt, Homo sapiens
guguuugcccuuuauuaug

SEQ ID NO: 1588932 - RNA, 19 nt, Homo sapiens
ucuugguguuugcccuuua

SEQ ID NO: 1588933 - RNA, 19 nt, Homo sapiens
ggguaccaccguuauaagu

SEQ ID NO: 1588934 - RNA, 19 nt, Homo sapiens
gcuaaacacgaagcagaau

SEQ ID NO: 1588935 - RNA, 19 nt, Homo sapiens
gaugacucaauugcugaua

SEQ ID NO: 1588936 - RNA, 19 nt, Homo sapiens
gcagaagaaugggauauuu

SEQ ID NO: 1588937 - RNA, 19 nt, Homo sapiens
ugaaagugcuuaugcuuaa

SEQ ID NO: 1588938 - RNA, 19 nt, Homo sapiens
gauauuguauucccaagaa

SEQ ID NO: 1588939 - RNA, 19 nt, Homo sapiens
gaacucaacugaaaucacu

SEQ ID NO: 1588940 - RNA, 19 nt, Homo sapiens
ggagauaucacacaaauuc

SEQ ID NO: 1588941 - RNA, 19 nt, Homo sapiens
gaaagacugcuacuaaaga

SEQ ID NO: 1588942 - RNA, 19 nt, Homo sapiens
uuacggaacucaacugaaa

SEQ ID NO: 1588943 - RNA, 19 nt, Homo sapiens
ggagugaggcccacaguaa

SEQ ID NO: 1588944 - RNA, 19 nt, Homo sapiens
uauggaaccuugcauuauu

SEQ ID NO: 1588945 - RNA, 19 nt, Homo sapiens
agaaguggcugauccuaaa

SEQ ID NO: 1588946 - RNA, 19 nt, Homo sapiens
gguuggcuaucuuuacuua

SEQ ID NO: 1588947 - RNA, 19 nt, Homo sapiens
ggaaggaaggauacacaua

SEQ ID NO: 1588948 - RNA, 19 nt, Homo sapiens
ucaaggcuaugacaauaaa

SEQ ID NO: 1588949 - RNA, 19 nt, Homo sapiens
ugaagaugaugaggauuua

SEQ ID NO: 1588950 - RNA, 19 nt, Homo sapiens
gcauuuacuuuggugauuu

SEQ ID NO: 1588951 - RNA, 19 nt, Homo sapiens
gauaacaacuccuaaucgu

SEQ ID NO: 1588952 - RNA, 19 nt, Homo sapiens
gagguuggucuucuuguua

SEQ ID NO: 1588953 - RNA, 19 nt, Homo sapiens
uaaacuucguccagauaua

SEQ ID NO: 1588954 - RNA, 19 nt, Homo sapiens
uaaggcagaugaugaagau

SEQ ID NO: 1588955 - RNA, 19 nt, Homo sapiens
gacaauuaaugcagaaugu

SEQ ID NO: 1588956 - RNA, 19 nt, Homo sapiens
ggaaugaagccaccaguca

SEQ ID NO: 1588957 - RNA, 19 nt, Homo sapiens
gaacgccaguugcauuuac

SEQ ID NO: 1588958 - RNA, 19 nt, Homo sapiens
ucacuacaguucugacuau

SEQ ID NO: 1588959 - RNA, 19 nt, Homo sapiens
ugacaguuguucuuucuug

SEQ ID NO: 1588960 - RNA, 19 nt, Homo sapiens
ugaaggagauaucacacaa

SEQ ID NO: 1588961 - RNA, 19 nt, Homo sapiens
gccaggaagucuuuaccua

SEQ ID NO: 1588962 - RNA, 19 nt, Homo sapiens
gaugcucacuggauaacaa

SEQ ID NO: 1588963 - RNA, 19 nt, Homo sapiens
gaauauggaaccuugcauu

SEQ ID NO: 1588964 - RNA, 19 nt, Homo sapiens
ccuaaauacuggagauuau

SEQ ID NO: 1588965 - RNA, 19 nt, Homo sapiens
gaaggaaggauacacauac

SEQ ID NO: 1588966 - RNA, 19 nt, Homo sapiens
gauccacucugauuccaau

SEQ ID NO: 1588967 - RNA, 19 nt, Homo sapiens
cgauggaucucuuuguuuc

SEQ ID NO: 1588968 - RNA, 19 nt, Homo sapiens
agaaugggauauuucacua

SEQ ID NO: 1588969 - RNA, 19 nt, Homo sapiens
acaguaauaugguuggaaa

SEQ ID NO: 1588970 - RNA, 19 nt, Homo sapiens
cuucaaggcuaugacaaua

SEQ ID NO: 1588971 - RNA, 19 nt, Homo sapiens
aaggaaagacugcuacuaa

SEQ ID NO: 1588972 - RNA, 19 nt, Homo sapiens
ugacaacccugaguacaau

SEQ ID NO: 1588973 - RNA, 19 nt, Homo sapiens
aaacagcauuggaccaguu

SEQ ID NO: 1588974 - RNA, 19 nt, Homo sapiens
gggaaacuguguugauaag

SEQ ID NO: 1588975 - RNA, 19 nt, Homo sapiens
ggaaagacugcuacuaaag

SEQ ID NO: 1588976 - RNA, 19 nt, Homo sapiens
ccaguugauccaauuaaua

SEQ ID NO: 1588977 - RNA, 19 nt, Homo sapiens
gaacaaaaccugggucuug

SEQ ID NO: 1588978 - RNA, 19 nt, Homo sapiens
gagauuauaucaguuugca

SEQ ID NO: 1588979 - RNA, 19 nt, Homo sapiens
caauaaacuucguccagau

SEQ ID NO: 1588980 - RNA, 19 nt, Homo sapiens
aggaaagacugcuacuaaa

SEQ ID NO: 1588981 - RNA, 19 nt, Homo sapiens
ccaggaagucuuuaccuaa

SEQ ID NO: 1588982 - RNA, 19 nt, Homo sapiens
gugcuuaugcuuaacagua

SEQ ID NO: 1588983 - RNA, 19 nt, Homo sapiens
gauuauggguaucaguguu

SEQ ID NO: 1588984 - RNA, 19 nt, Homo sapiens
gauaucacacaaauucuga

SEQ ID NO: 1588985 - RNA, 19 nt, Homo sapiens
gauggacgaguucuguaua

SEQ ID NO: 1588986 - RNA, 19 nt, Homo sapiens
ggaccaguugauccaauua

SEQ ID NO: 1588987 - RNA, 19 nt, Homo sapiens
aaggagauaucacacaaau

SEQ ID NO: 1588988 - RNA, 19 nt, Homo sapiens
aauauggaaccuugcauua

SEQ ID NO: 1588989 - RNA, 19 nt, Homo sapiens
gaccugagcagaagaaugg

SEQ ID NO: 1588990 - RNA, 19 nt, Homo sapiens
gauccuaaauacuggagau

SEQ ID NO: 1588991 - RNA, 19 nt, Homo sapiens
aauguuaucuucagcuuca

SEQ ID NO: 1588992 - RNA, 19 nt, Homo sapiens
gaaggagauaucacacaaa

SEQ ID NO: 1588993 - RNA, 19 nt, Homo sapiens
gcagcuuucaggcuaauuu

SEQ ID NO: 1588994 - RNA, 19 nt, Homo sapiens
gcaaagauugugccagcuu

SEQ ID NO: 1588995 - RNA, 19 nt, Homo sapiens
agaagaugauuauggguau

SEQ ID NO: 1588996 - RNA, 19 nt, Homo sapiens
ccacucugauuccaaugaa

SEQ ID NO: 1588997 - RNA, 19 nt, Homo sapiens
ggauuuaacggugaacaaa

SEQ ID NO: 1588998 - RNA, 19 nt, Homo sapiens
ugaugaagaugaugaggau

SEQ ID NO: 1588999 - RNA, 19 nt, Homo sapiens
ugaguacaauugccaggaa

SEQ ID NO: 1589000 - RNA, 19 nt, Homo sapiens
gaccuacauuccaugcauu

SEQ ID NO: 1589001 - RNA, 19 nt, Homo sapiens
gggauuauguuaucaugac

SEQ ID NO: 1589002 - RNA, 19 nt, Homo sapiens
ugauuacccugcuugaaau

SEQ ID NO: 1589003 - RNA, 19 nt, Homo sapiens
ugacugcgauggaucucuu

SEQ ID NO: 1589004 - RNA, 19 nt, Homo sapiens
caggaagucuuuaccuaag

SEQ ID NO: 1589005 - RNA, 19 nt, Homo sapiens
uacauuccaugcauucuga

SEQ ID NO: 1589006 - RNA, 19 nt, Homo sapiens
caggcuaauuuacgugaaa

SEQ ID NO: 1589007 - RNA, 19 nt, Homo sapiens
uugggaaacuguguugaua

SEQ ID NO: 1589008 - RNA, 19 nt, Homo sapiens
gaacaucguuggguaucac

SEQ ID NO: 1589009 - RNA, 19 nt, Homo sapiens
ggauauuucacuauucaga

SEQ ID NO: 1589010 - RNA, 19 nt, Homo sapiens
gcuuaacaguaauaugguu

SEQ ID NO: 1589011 - RNA, 19 nt, Homo sapiens
ccaguugcauuuacuuugg

SEQ ID NO: 1589012 - RNA, 19 nt, Homo sapiens
cuuccaagauauuguauuc

SEQ ID NO: 1589013 - RNA, 19 nt, Homo sapiens
gcgauggaucucuuuguuu

SEQ ID NO: 1589014 - RNA, 19 nt, Homo sapiens
gaagaugaugaggauuuaa

SEQ ID NO: 1589015 - RNA, 19 nt, Homo sapiens
cagaacgccaguugcauuu

SEQ ID NO: 1589016 - RNA, 19 nt, Homo sapiens
ugagguuggucuucuuguu

SEQ ID NO: 1589017 - RNA, 19 nt, Homo sapiens
guaaauaaaguagcagcuu

SEQ ID NO: 1589018 - RNA, 19 nt, Homo sapiens
gaagacugcagaacaggau

SEQ ID NO: 1589019 - RNA, 19 nt, Homo sapiens
uugcagccuugauggaaua

SEQ ID NO: 1589020 - RNA, 19 nt, Homo sapiens
ugggauauuucacuauuca

SEQ ID NO: 1589021 - RNA, 19 nt, Homo sapiens
guuugcauuuguaggguua

SEQ ID NO: 1589022 - RNA, 19 nt, Homo sapiens
aaucgucugcuucgaauuu

SEQ ID NO: 1589023 - RNA, 19 nt, Homo sapiens
cuaaucgucugcuucgaau

SEQ ID NO: 1589024 - RNA, 19 nt, Homo sapiens
aauaaacuucguccagaua

SEQ ID NO: 1589025 - RNA, 19 nt, Homo sapiens
uuacuuuggugauuugcaa

SEQ ID NO: 1589026 - RNA, 19 nt, Homo sapiens
aaacagaacgccaguugca

SEQ ID NO: 1589027 - RNA, 19 nt, Homo sapiens
gaagaugauuauggguauc

SEQ ID NO: 1589028 - RNA, 19 nt, Homo sapiens
ucuguauacucuaagauug

SEQ ID NO: 1589029 - RNA, 19 nt, Homo sapiens
gaccaguugauccaauuaa

SEQ ID NO: 1589030 - RNA, 19 nt, Homo sapiens
uuuauucucugcuucauag

SEQ ID NO: 1589031 - RNA, 19 nt, Homo sapiens
uccgauggguccuuugaaa

SEQ ID NO: 1589032 - RNA, 19 nt, Homo sapiens
uuaaacagaacgccaguug

SEQ ID NO: 1589033 - RNA, 19 nt, Homo sapiens
ugauaaggcagaugaugaa

SEQ ID NO: 1589034 - RNA, 19 nt, Homo sapiens
cagcuuucaggcuaauuua

SEQ ID NO: 1589035 - RNA, 19 nt, Homo sapiens
acacauacgcauugccaaa

SEQ ID NO: 1589036 - RNA, 19 nt, Homo sapiens
ggacagcccuggacgauuu

SEQ ID NO: 1589037 - RNA, 19 nt, Homo sapiens
ggacaauccuuucauuaau

SEQ ID NO: 1589038 - RNA, 19 nt, Homo sapiens
ggacaaagacccagcuaau

SEQ ID NO: 1589039 - RNA, 19 nt, Homo sapiens
gaaggaggguggccugcaa

SEQ ID NO: 1589040 - RNA, 19 nt, Homo sapiens
ccaagccucuacaucauaa

SEQ ID NO: 1589041 - RNA, 19 nt, Homo sapiens
gggacaauccuuucauuaa

SEQ ID NO: 1589042 - RNA, 19 nt, Homo sapiens
caaccuauaugaccagauc

SEQ ID NO: 1589043 - RNA, 19 nt, Homo sapiens
gagaagaguccagaaagaa

SEQ ID NO: 1589044 - RNA, 19 nt, Homo sapiens
ucaggucaguggagucuuu

SEQ ID NO: 1589045 - RNA, 19 nt, Homo sapiens
gaagaguccagaaagaaga

SEQ ID NO: 1589046 - RNA, 19 nt, Homo sapiens
agagaagaguccagaaaga

SEQ ID NO: 1589047 - RNA, 19 nt, Homo sapiens
gaaaggccuuccguccauu

SEQ ID NO: 1589048 - RNA, 19 nt, Homo sapiens
gaaggucgaauuaaguaug

SEQ ID NO: 1589049 - RNA, 19 nt, Homo sapiens
gcagugaaggucgaauuaa

SEQ ID NO: 1589050 - RNA, 19 nt, Homo sapiens
gugaaggucgaauuaagua

SEQ ID NO: 1589051 - RNA, 19 nt, Homo sapiens
ccucaucagugucuacuuc

SEQ ID NO: 1589052 - RNA, 19 nt, Homo sapiens
ccagagaagaguccagaaa

SEQ ID NO: 1589053 - RNA, 19 nt, Homo sapiens
gacaaagacccagcuaaug

SEQ ID NO: 1589054 - RNA, 19 nt, Homo sapiens
ucuguaaacuggacaucuu

SEQ ID NO: 1589055 - RNA, 19 nt, Homo sapiens
ggucgaauuaaguaugaua

SEQ ID NO: 1589056 - RNA, 19 nt, Homo sapiens
agaaaggccuuccguccau

SEQ ID NO: 1589057 - RNA, 19 nt, Homo sapiens
aagcaguguuugacagaaa

SEQ ID NO: 1589058 - RNA, 19 nt, Homo sapiens
caaagacccagcuaaugga

SEQ ID NO: 1589059 - RNA, 19 nt, Homo sapiens
ggccaagccucuacaucau

SEQ ID NO: 1589060 - RNA, 19 nt, Homo sapiens
ugacaucauuccuguggau

SEQ ID NO: 1589061 - RNA, 19 nt, Homo sapiens
caaacaacagcuuggaguu

SEQ ID NO: 1589062 - RNA, 19 nt, Homo sapiens
gaacaccuaggcagacauc

SEQ ID NO: 1589063 - RNA, 19 nt, Homo sapiens
acaaagacccagcuaaugg

SEQ ID NO: 1589064 - RNA, 19 nt, Homo sapiens
gccaagccucuacaucaua

SEQ ID NO: 1589065 - RNA, 19 nt, Homo sapiens
gguugacccugcugucuuc

SEQ ID NO: 1589066 - RNA, 19 nt, Homo sapiens
cagugaaggucgaauuaag

SEQ ID NO: 1589067 - RNA, 19 nt, Homo sapiens
ggaguuagcagggaagaag

SEQ ID NO: 1589068 - RNA, 19 nt, Homo sapiens
aaggucgaauuaaguauga

SEQ ID NO: 1589069 - RNA, 19 nt, Homo sapiens
guaaacuggacaucuucua

SEQ ID NO: 1589070 - RNA, 19 nt, Homo sapiens
caagcaguguuugacagaa

SEQ ID NO: 1589071 - RNA, 19 nt, Homo sapiens
acaaggaggugugggagau

SEQ ID NO: 1589072 - RNA, 19 nt, Homo sapiens
caaugagggugaccagcau

SEQ ID NO: 1589073 - RNA, 19 nt, Homo sapiens
guucuuuccucuacacagu

SEQ ID NO: 1589074 - RNA, 19 nt, Homo sapiens
cgaauuaaguaugauaagc

SEQ ID NO: 1589075 - RNA, 19 nt, Homo sapiens
caucaauaaacucacagua

SEQ ID NO: 1589076 - RNA, 19 nt, Homo sapiens
guggauggauuugguaugg

SEQ ID NO: 1589077 - RNA, 19 nt, Homo sapiens
ccugaucaauggaaguuca

SEQ ID NO: 1589078 - RNA, 19 nt, Homo sapiens
aacaacagcuuggaguuuc

SEQ ID NO: 1589079 - RNA, 19 nt, Homo sapiens
caucaauugcucaggcuuu

SEQ ID NO: 1589080 - RNA, 19 nt, Homo sapiens
ugggacaauccuuucauua

SEQ ID NO: 1589081 - RNA, 19 nt, Homo sapiens
uggagucuuuccuugauug

SEQ ID NO: 1589082 - RNA, 19 nt, Homo sapiens
gcacuagcaagcagguuca

SEQ ID NO: 1589083 - RNA, 19 nt, Homo sapiens
ggacucauuuuccuaaucu

SEQ ID NO: 1589084 - RNA, 19 nt, Homo sapiens
gggccagccggacucauuu

SEQ ID NO: 1589085 - RNA, 19 nt, Homo sapiens
uaaguaugauaagccaaug

SEQ ID NO: 1589086 - RNA, 19 nt, Homo sapiens
guggagucuuuccuugauu

SEQ ID NO: 1589087 - RNA, 19 nt, Homo sapiens
ggaagaggcgacgcuuuua

SEQ ID NO: 1589088 - RNA, 19 nt, Homo sapiens
ccaagcaguguuugacaga

SEQ ID NO: 1589089 - RNA, 19 nt, Homo sapiens
gcuuucugguugccauuga

SEQ ID NO: 1589090 - RNA, 19 nt, Homo sapiens
cagcagugaaggucgaauu

SEQ ID NO: 1589091 - RNA, 19 nt, Homo sapiens
ugacccugcugucuuccaa

SEQ ID NO: 1589092 - RNA, 19 nt, Homo sapiens
cagcagagagcgagaaucg

SEQ ID NO: 1589093 - RNA, 19 nt, Homo sapiens
cagagaagaguccagaaag

SEQ ID NO: 1589094 - RNA, 19 nt, Homo sapiens
gaccagaucauguuuuaug

SEQ ID NO: 1589095 - RNA, 19 nt, Homo sapiens
cuucaguucuuuccucuac

SEQ ID NO: 1589096 - RNA, 19 nt, Homo sapiens
uggcaucaauaaacucaca

SEQ ID NO: 1589097 - RNA, 19 nt, Homo sapiens
gaguguguuggcaucaaua

SEQ ID NO: 1589098 - RNA, 19 nt, Homo sapiens
gagggugaccagcaucugu

SEQ ID NO: 1589099 - RNA, 19 nt, Homo sapiens
gguaugggacaauccuuuc

SEQ ID NO: 1589100 - RNA, 19 nt, Homo sapiens
gauggacacccugcucuuc

SEQ ID NO: 1589101 - RNA, 19 nt, Homo sapiens
cauccuuacugucauuguc

SEQ ID NO: 1589102 - RNA, 19 nt, Homo sapiens
aauaagggccugggucuca

SEQ ID NO: 1589103 - RNA, 19 nt, Homo sapiens
gaccagcaucuguaaacug

SEQ ID NO: 1589104 - RNA, 19 nt, Homo sapiens
ucauuccuguggauggauu

SEQ ID NO: 1589105 - RNA, 19 nt, Homo sapiens
agucuuuccuugauugauc

SEQ ID NO: 1589106 - RNA, 19 nt, Homo sapiens
ggagucuuuccuugauuga

SEQ ID NO: 1589107 - RNA, 19 nt, Homo sapiens
cuacuucccuuuugaccaa

SEQ ID NO: 1589108 - RNA, 19 nt, Homo sapiens
uaaacuggacaucuucuac

SEQ ID NO: 1589109 - RNA, 19 nt, Homo sapiens
acuccucacucccugauca

SEQ ID NO: 1589110 - RNA, 19 nt, Homo sapiens
ccuccuccauccuuacugu

SEQ ID NO: 1589111 - RNA, 19 nt, Homo sapiens
ggucucacugccuauauca

SEQ ID NO: 1589112 - RNA, 19 nt, Homo sapiens
agaguguguuggcaucaau

SEQ ID NO: 1589113 - RNA, 19 nt, Homo sapiens
agagagaccgagccagaug

SEQ ID NO: 1589114 - RNA, 19 nt, Homo sapiens
caugggcaacaaccuauau

SEQ ID NO: 1589115 - RNA, 19 nt, Homo sapiens
guccaugggcaacaaccua

SEQ ID NO: 1589116 - RNA, 19 nt, Homo sapiens
ugggagcucuugggcauca

SEQ ID NO: 1589117 - RNA, 19 nt, Homo sapiens
aacuguaccuucaccuuca

SEQ ID NO: 1589118 - RNA, 19 nt, Homo sapiens
agcagugaaggucgaauua

SEQ ID NO: 1589119 - RNA, 19 nt, Homo sapiens
aguggagucuuuccuugau

SEQ ID NO: 1589120 - RNA, 19 nt, Homo sapiens
caguggagucuuuccuuga

SEQ ID NO: 1589121 - RNA, 19 nt, Homo sapiens
uugaugcccucagcuucua

SEQ ID NO: 1589122 - RNA, 19 nt, Homo sapiens
ccaugggcaacaaccuaua

SEQ ID NO: 1589123 - RNA, 19 nt, Homo sapiens
aacuggacaucuucuacuu

SEQ ID NO: 1589124 - RNA, 19 nt, Homo sapiens
uaaacucacaguauuagcu

SEQ ID NO: 1589125 - RNA, 19 nt, Homo sapiens
gaaggaagauggcgacaga

SEQ ID NO: 1589126 - RNA, 19 nt, Homo sapiens
gaagauggcgacagaugaa

SEQ ID NO: 1589127 - RNA, 19 nt, Homo sapiens
gaaggcaacuugguuaagg

SEQ ID NO: 1589128 - RNA, 19 nt, Homo sapiens
ggacaagugccacguggaa

SEQ ID NO: 1589129 - RNA, 19 nt, Homo sapiens
ggaagauggcgacagauga

SEQ ID NO: 1589130 - RNA, 19 nt, Homo sapiens
aagggaggcugaauucuug

SEQ ID NO: 1589131 - RNA, 19 nt, Homo sapiens
ugauguguaugcagaguuu

SEQ ID NO: 1589132 - RNA, 19 nt, Homo sapiens
gcaucaccuuugcaacuuu

SEQ ID NO: 1589133 - RNA, 19 nt, Homo sapiens
gaaaaugucuaugguuuag

SEQ ID NO: 1589134 - RNA, 19 nt, Homo sapiens
ugacagcgcagguccuaaa

SEQ ID NO: 1589135 - RNA, 19 nt, Homo sapiens
ucuuggagcugaagggaaa

SEQ ID NO: 1589136 - RNA, 19 nt, Homo sapiens
uaagggaggcugaauucuu

SEQ ID NO: 1589137 - RNA, 19 nt, Homo sapiens
caucaccuuugcaacuuug

SEQ ID NO: 1589138 - RNA, 19 nt, Homo sapiens
guuaagggaggcugaauuc

SEQ ID NO: 1589139 - RNA, 19 nt, Homo sapiens
ugccaaagcucagaguuca

SEQ ID NO: 1589140 - RNA, 19 nt, Homo sapiens
gaagggaaagcagcagguu

SEQ ID NO: 1589141 - RNA, 19 nt, Homo sapiens
gauggcgacagaugaagaa

SEQ ID NO: 1589142 - RNA, 19 nt, Homo sapiens
guaguuucaggcauaguuu

SEQ ID NO: 1589143 - RNA, 19 nt, Homo sapiens
gaagaaaaugucuaugguu

SEQ ID NO: 1589144 - RNA, 19 nt, Homo sapiens
acucacagccgaagggaaa

SEQ ID NO: 1589145 - RNA, 19 nt, Homo sapiens
ggggcucccugcacgauua

SEQ ID NO: 1589146 - RNA, 19 nt, Homo sapiens
gguuaagggaggcugaauu

SEQ ID NO: 1589147 - RNA, 19 nt, Homo sapiens
gcaggugagggacauguuc

SEQ ID NO: 1589148 - RNA, 19 nt, Homo sapiens
acugaaggcaacuugguua

SEQ ID NO: 1589149 - RNA, 19 nt, Homo sapiens
gcgcagguccuaaaacuga

SEQ ID NO: 1589150 - RNA, 19 nt, Homo sapiens
cguggacacuccggacauu

SEQ ID NO: 1589151 - RNA, 19 nt, Homo sapiens
ggcgacagaugaagaaaau

SEQ ID NO: 1589152 - RNA, 19 nt, Homo sapiens
ggccagagacgguucuucu

SEQ ID NO: 1589153 - RNA, 19 nt, Homo sapiens
ggucugugccuuugauaac

SEQ ID NO: 1589154 - RNA, 19 nt, Homo sapiens
cggaggcucauccuuguug

SEQ ID NO: 1589155 - RNA, 19 nt, Homo sapiens
cgcggaggcucauccuugu

SEQ ID NO: 1589156 - RNA, 19 nt, Homo sapiens
ugaagaaaaugucuauggu

SEQ ID NO: 1589157 - RNA, 19 nt, Homo sapiens
aaacugaaggcaacuuggu

SEQ ID NO: 1589158 - RNA, 19 nt, Homo sapiens
gggucugugccuuugauaa

SEQ ID NO: 1589159 - RNA, 19 nt, Homo sapiens
gcucccaaguguccaagac

SEQ ID NO: 1589160 - RNA, 19 nt, Homo sapiens
gggaggagcucgagaucuu

SEQ ID NO: 1589161 - RNA, 19 nt, Homo sapiens
ggaaaccuguguucaagau

SEQ ID NO: 1589162 - RNA, 19 nt, Homo sapiens
cagcuuugauccuuuguaa

SEQ ID NO: 1589163 - RNA, 19 nt, Homo sapiens
ugaagaaggucaaaguaca

SEQ ID NO: 1589164 - RNA, 19 nt, Homo sapiens
ggaggguuguuccagcuuu

SEQ ID NO: 1589165 - RNA, 19 nt, Homo sapiens
gcuuugauccuuuguaaga

SEQ ID NO: 1589166 - RNA, 19 nt, Homo sapiens
gaugguuacuugcuaugga

SEQ ID NO: 1589167 - RNA, 19 nt, Homo sapiens
caacaucaccuccgucucu

SEQ ID NO: 1589168 - RNA, 19 nt, Homo sapiens
gcuccagcccugaugguua

SEQ ID NO: 1589169 - RNA, 19 nt, Homo sapiens
aaaccuguguucaagauuc

SEQ ID NO: 1589170 - RNA, 19 nt, Homo sapiens
cuaaauaaagcaagcaguu

SEQ ID NO: 1589171 - RNA, 19 nt, Homo sapiens
guuacuugcuauggaauuu

SEQ ID NO: 1589172 - RNA, 19 nt, Homo sapiens
ccucggaagugaugccuau

SEQ ID NO: 1589173 - RNA, 19 nt, Homo sapiens
aaguacagcugcagugugu

SEQ ID NO: 1589174 - RNA, 19 nt, Homo sapiens
gaggguuguuccagcuuug

SEQ ID NO: 1589175 - RNA, 19 nt, Homo sapiens
gaagaaggucaaaguacag

SEQ ID NO: 1589176 - RNA, 19 nt, Homo sapiens
ggagggaggagcucgagau

SEQ ID NO: 1589177 - RNA, 19 nt, Homo sapiens
uaaauaaagcaagcaguuc

SEQ ID NO: 1589178 - RNA, 19 nt, Homo sapiens
guuccagcuuugauccuuu

SEQ ID NO: 1589179 - RNA, 19 nt, Homo sapiens
gaaaccuguguucaagauu

SEQ ID NO: 1589180 - RNA, 19 nt, Homo sapiens
ccugaagaaggucaaagua

SEQ ID NO: 1589181 - RNA, 19 nt, Homo sapiens
cucaaacccugguccucua

SEQ ID NO: 1589182 - RNA, 19 nt, Homo sapiens
caaaguacagcugcagugu

SEQ ID NO: 1589183 - RNA, 19 nt, Homo sapiens
ccugaugguuacuugcuau

SEQ ID NO: 1589184 - RNA, 19 nt, Homo sapiens
cagcccugaugguuacuug

SEQ ID NO: 1589185 - RNA, 19 nt, Homo sapiens
gggaaaccuguguucaaga

SEQ ID NO: 1589186 - RNA, 19 nt, Homo sapiens
gcccuuaccccuaaauaaa

SEQ ID NO: 1589187 - RNA, 19 nt, Homo sapiens
caucccaggcugccacuug

SEQ ID NO: 1589188 - RNA, 19 nt, Homo sapiens
gaggagcucgagaucuuca

SEQ ID NO: 1589189 - RNA, 19 nt, Homo sapiens
aaauaaagcaagcaguucu

SEQ ID NO: 1589190 - RNA, 19 nt, Homo sapiens
ucgccucucucgcuacuag

SEQ ID NO: 1589191 - RNA, 19 nt, Homo sapiens
ucauuuuacuucccucuuu

SEQ ID NO: 1589192 - RNA, 19 nt, Homo sapiens
aaacccugguccucuaucu

SEQ ID NO: 1589193 - RNA, 19 nt, Homo sapiens
guaauaagcucaucuaaag

SEQ ID NO: 1589194 - RNA, 19 nt, Homo sapiens
ggaagcaggucuaagugua

SEQ ID NO: 1589195 - RNA, 19 nt, Homo sapiens
gacaagagcauucuccuua

SEQ ID NO: 1589196 - RNA, 19 nt, Homo sapiens
gcagaaauauauccaaagu

SEQ ID NO: 1589197 - RNA, 19 nt, Homo sapiens
ggacauucauauccuuaaa

SEQ ID NO: 1589198 - RNA, 19 nt, Homo sapiens
gaaacuugccuguauuauu

SEQ ID NO: 1589199 - RNA, 19 nt, Homo sapiens
ccaguugguugauaagaua

SEQ ID NO: 1589200 - RNA, 19 nt, Homo sapiens
guagaacaauugaagaaga

SEQ ID NO: 1589201 - RNA, 19 nt, Homo sapiens
gaacuucuuacccuauuaa

SEQ ID NO: 1589202 - RNA, 19 nt, Homo sapiens
gaaaacggcuugcuaaucu

SEQ ID NO: 1589203 - RNA, 19 nt, Homo sapiens
gaauuccucucgugccaaa

SEQ ID NO: 1589204 - RNA, 19 nt, Homo sapiens
agacaaaggauacagcaua

SEQ ID NO: 1589205 - RNA, 19 nt, Homo sapiens
gaagcaggucuaaguguaa

SEQ ID NO: 1589206 - RNA, 19 nt, Homo sapiens
acacccagcucuccagaaa

SEQ ID NO: 1589207 - RNA, 19 nt, Homo sapiens
ggaccuggaugccaauaag

SEQ ID NO: 1589208 - RNA, 19 nt, Homo sapiens
gacaguugcuuguaaugau

SEQ ID NO: 1589209 - RNA, 19 nt, Homo sapiens
uaucucaucugcacaggaa

SEQ ID NO: 1589210 - RNA, 19 nt, Homo sapiens
gcuauaauauccagugcau

SEQ ID NO: 1589211 - RNA, 19 nt, Homo sapiens
gucaucgcauuccuuaaua

SEQ ID NO: 1589212 - RNA, 19 nt, Homo sapiens
gacaaaggauacagcauac

SEQ ID NO: 1589213 - RNA, 19 nt, Homo sapiens
gcccagaaauucagacaag

SEQ ID NO: 1589214 - RNA, 19 nt, Homo sapiens
gcaaggcaaggaagagauu

SEQ ID NO: 1589215 - RNA, 19 nt, Homo sapiens
caagagcauucuccuuauc

SEQ ID NO: 1589216 - RNA, 19 nt, Homo sapiens
gcacaggaagcaggucuaa

SEQ ID NO: 1589217 - RNA, 19 nt, Homo sapiens
agcgagagcucacggaauu

SEQ ID NO: 1589218 - RNA, 19 nt, Homo sapiens
ggaccacgcagacucagaa

SEQ ID NO: 1589219 - RNA, 19 nt, Homo sapiens
ugaacuucuuacccuauua

SEQ ID NO: 1589220 - RNA, 19 nt, Homo sapiens
uuucuaagauggacauuca

SEQ ID NO: 1589221 - RNA, 19 nt, Homo sapiens
ugagucaucgcauuccuua

SEQ ID NO: 1589222 - RNA, 19 nt, Homo sapiens
gcaggucuaaguguaauuu

SEQ ID NO: 1589223 - RNA, 19 nt, Homo sapiens
gguggcagcucugacaguu

SEQ ID NO: 1589224 - RNA, 19 nt, Homo sapiens
acaagagcauucuccuuau

SEQ ID NO: 1589225 - RNA, 19 nt, Homo sapiens
cgaaguggauuuuaaugaa

SEQ ID NO: 1589226 - RNA, 19 nt, Homo sapiens
gauggacauucauauccuu

SEQ ID NO: 1589227 - RNA, 19 nt, Homo sapiens
uuuauacccuucagaucua

SEQ ID NO: 1589228 - RNA, 19 nt, Homo sapiens
aggcagaaauauauccaaa

SEQ ID NO: 1589229 - RNA, 19 nt, Homo sapiens
ugaauuaugugccccuuaa

SEQ ID NO: 1589230 - RNA, 19 nt, Homo sapiens
ccugaaacuugccuguauu

SEQ ID NO: 1589231 - RNA, 19 nt, Homo sapiens
ucauaugcccuaccugaaa

SEQ ID NO: 1589232 - RNA, 19 nt, Homo sapiens
acaguugcuuguaaugauu

SEQ ID NO: 1589233 - RNA, 19 nt, Homo sapiens
ucgcauuccuuaauagugu

SEQ ID NO: 1589234 - RNA, 19 nt, Homo sapiens
uagcuacuuucaaaugaga

SEQ ID NO: 1589235 - RNA, 19 nt, Homo sapiens
gaaauucagacaagagcau

SEQ ID NO: 1589236 - RNA, 19 nt, Homo sapiens
ccaauaaggacaacgaagu

SEQ ID NO: 1589237 - RNA, 19 nt, Homo sapiens
uaagauggacauucauauc

SEQ ID NO: 1589238 - RNA, 19 nt, Homo sapiens
ucuaagauggacauucaua

SEQ ID NO: 1589239 - RNA, 19 nt, Homo sapiens
cagaacagcacuacucaca

SEQ ID NO: 1589240 - RNA, 19 nt, Homo sapiens
gcauucuccuuaucucauc

SEQ ID NO: 1589241 - RNA, 19 nt, Homo sapiens
caauaaggacaacgaagug

SEQ ID NO: 1589242 - RNA, 19 nt, Homo sapiens
ucaucuaaaggcagaaaua

SEQ ID NO: 1589243 - RNA, 19 nt, Homo sapiens
gaacaauugaagaagaaag

SEQ ID NO: 1589244 - RNA, 19 nt, Homo sapiens
gaggcuauaugcaucuuuu

SEQ ID NO: 1589245 - RNA, 19 nt, Homo sapiens
cugaaacuugccuguauua

SEQ ID NO: 1589246 - RNA, 19 nt, Homo sapiens
acaacgaaguggauuuuaa

SEQ ID NO: 1589247 - RNA, 19 nt, Homo sapiens
caucuaaaggcagaaauau

SEQ ID NO: 1589248 - RNA, 19 nt, Homo sapiens
acaggaagcaggucuaagu

SEQ ID NO: 1589249 - RNA, 19 nt, Homo sapiens
gaggaaaacggcuugcuaa

SEQ ID NO: 1589250 - RNA, 19 nt, Homo sapiens
ugacaguugcuuguaauga

SEQ ID NO: 1589251 - RNA, 19 nt, Homo sapiens
gcucugacaguugcuugua

SEQ ID NO: 1589252 - RNA, 19 nt, Homo sapiens
gagcauucuccuuaucuca

SEQ ID NO: 1589253 - RNA, 19 nt, Homo sapiens
ggacaacgaaguggauuuu

SEQ ID NO: 1589254 - RNA, 19 nt, Homo sapiens
caaaggauacagcauacag

SEQ ID NO: 1589255 - RNA, 19 nt, Homo sapiens
cauaugcccuaccugaaac

SEQ ID NO: 1589256 - RNA, 19 nt, Homo sapiens
gaagaaaggaaaauaaagg

SEQ ID NO: 1589257 - RNA, 19 nt, Homo sapiens
caauugaagaagaaaggaa

SEQ ID NO: 1589258 - RNA, 19 nt, Homo sapiens
uauagacccaguaauguca

SEQ ID NO: 1589259 - RNA, 19 nt, Homo sapiens
cuaagauggacauucauau

SEQ ID NO: 1589260 - RNA, 19 nt, Homo sapiens
ucugacaguugcuuguaau

SEQ ID NO: 1589261 - RNA, 19 nt, Homo sapiens
agucaucgcauuccuuaau

SEQ ID NO: 1589262 - RNA, 19 nt, Homo sapiens
uugaacuucuuacccuauu

SEQ ID NO: 1589263 - RNA, 19 nt, Homo sapiens
ggaggaaaacggcuugcua

SEQ ID NO: 1589264 - RNA, 19 nt, Homo sapiens
accugaaacuugccuguau

SEQ ID NO: 1589265 - RNA, 19 nt, Homo sapiens
ggaaaacggcuugcuaauc

SEQ ID NO: 1589266 - RNA, 19 nt, Homo sapiens
gguaaguaauaagcucauc

SEQ ID NO: 1589267 - RNA, 19 nt, Homo sapiens
cccaguugguugauaagau

SEQ ID NO: 1589268 - RNA, 19 nt, Homo sapiens
cuucuggaguggucaguuc

SEQ ID NO: 1589269 - RNA, 19 nt, Homo sapiens
ccacgcagacucagaacag

SEQ ID NO: 1589270 - RNA, 19 nt, Homo sapiens
aagcaggucuaaguguaau

SEQ ID NO: 1589271 - RNA, 19 nt, Homo sapiens
uaaggacaacgaaguggau

SEQ ID NO: 1589272 - RNA, 19 nt, Homo sapiens
uggacaccaugauuagaau

SEQ ID NO: 1589273 - RNA, 19 nt, Homo sapiens
caaggaagagauucaagcu

SEQ ID NO: 1589274 - RNA, 19 nt, Homo sapiens
ucauuuauacccuucagau

SEQ ID NO: 1589275 - RNA, 19 nt, Homo sapiens
caacgaaguggauuuuaau

SEQ ID NO: 1589276 - RNA, 19 nt, Homo sapiens
ccagaaauucagacaagag

SEQ ID NO: 1589277 - RNA, 19 nt, Homo sapiens
ucaucgcauuccuuaauag

SEQ ID NO: 1589278 - RNA, 19 nt, Homo sapiens
guaaguaauaagcucaucu

SEQ ID NO: 1589279 - RNA, 19 nt, Homo sapiens
caguucugcugccgacaug

SEQ ID NO: 1589280 - RNA, 19 nt, Homo sapiens
cgaggaagaucaacauaua

SEQ ID NO: 1589281 - RNA, 19 nt, Homo sapiens
gcacacauacuuacacuug

SEQ ID NO: 1589282 - RNA, 19 nt, Homo sapiens
acacuugcccugagacuua

SEQ ID NO: 1589283 - RNA, 19 nt, Homo sapiens
ucaagugccugaccuggaa

SEQ ID NO: 1589284 - RNA, 19 nt, Homo sapiens
ccacagguuuaaaugaaga

SEQ ID NO: 1589285 - RNA, 19 nt, Homo sapiens
agacuuaguucgaaaugug

SEQ ID NO: 1589286 - RNA, 19 nt, Homo sapiens
cagaaggcacacauacuua

SEQ ID NO: 1589287 - RNA, 19 nt, Homo sapiens
aagacaagcugaaacaaca

SEQ ID NO: 1589288 - RNA, 19 nt, Homo sapiens
gaggaaccaccaacugaaa

SEQ ID NO: 1589289 - RNA, 19 nt, Homo sapiens
gaagacaagcugaaacaac

SEQ ID NO: 1589290 - RNA, 19 nt, Homo sapiens
ucagaaggcacacauacuu

SEQ ID NO: 1589291 - RNA, 19 nt, Homo sapiens
uaaaugaagacaagcugaa

SEQ ID NO: 1589292 - RNA, 19 nt, Homo sapiens
gcgaggaagaucaacauau

SEQ ID NO: 1589293 - RNA, 19 nt, Homo sapiens
aauaugauuuggcgaggaa

SEQ ID NO: 1589294 - RNA, 19 nt, Homo sapiens
ggagagagaagaagaucag

SEQ ID NO: 1589295 - RNA, 19 nt, Homo sapiens
ggagcugucucagucaaag

SEQ ID NO: 1589296 - RNA, 19 nt, Homo sapiens
gaaggcacacauacuuaca

SEQ ID NO: 1589297 - RNA, 19 nt, Homo sapiens
caagaggaaccaccaacug

SEQ ID NO: 1589298 - RNA, 19 nt, Homo sapiens
gagacuuaguucgaaaugu

SEQ ID NO: 1589299 - RNA, 19 nt, Homo sapiens
guggaaaugguccugauga

SEQ ID NO: 1589300 - RNA, 19 nt, Homo sapiens
aagaggaaccaccaacuga

SEQ ID NO: 1589301 - RNA, 19 nt, Homo sapiens
ccugagacuuaguucgaaa

SEQ ID NO: 1589302 - RNA, 19 nt, Homo sapiens
gaggaagaucaacauauag

SEQ ID NO: 1589303 - RNA, 19 nt, Homo sapiens
caagcugaaacaacacaaa

SEQ ID NO: 1589304 - RNA, 19 nt, Homo sapiens
caggagcugucucagucaa

SEQ ID NO: 1589305 - RNA, 19 nt, Homo sapiens
ggaaccaccaacugaaagu

SEQ ID NO: 1589306 - RNA, 19 nt, Homo sapiens
gcaagaggaaccaccaacu

SEQ ID NO: 1589307 - RNA, 19 nt, Homo sapiens
gggugaauguggaaauggu

SEQ ID NO: 1589308 - RNA, 19 nt, Homo sapiens
gcccugagacuuaguucga

SEQ ID NO: 1589309 - RNA, 19 nt, Homo sapiens
aaaugaagacaagcugaaa

SEQ ID NO: 1589310 - RNA, 19 nt, Homo sapiens
guucgaaaugugaaauaug

SEQ ID NO: 1589311 - RNA, 19 nt, Homo sapiens
ggcgaggaagaucaacaua

SEQ ID NO: 1589312 - RNA, 19 nt, Homo sapiens
agaggaaccaccaacugaa

SEQ ID NO: 1589313 - RNA, 19 nt, Homo sapiens
gaaccaccaacugaaaguc

SEQ ID NO: 1589314 - RNA, 19 nt, Homo sapiens
cgaggaagaucaacauaua

SEQ ID NO: 1589315 - RNA, 19 nt, Homo sapiens
gcagcugugugaaauauga

SEQ ID NO: 1589316 - RNA, 19 nt, Homo sapiens
ucaagugccugaccuggaa

SEQ ID NO: 1589317 - RNA, 19 nt, Homo sapiens
ccacagguuuaaaugaaga

SEQ ID NO: 1589318 - RNA, 19 nt, Homo sapiens
aagacaagcugaaacaaca

SEQ ID NO: 1589319 - RNA, 19 nt, Homo sapiens
gaggaaccaccaacugaaa

SEQ ID NO: 1589320 - RNA, 19 nt, Homo sapiens
gaagacaagcugaaacaac

SEQ ID NO: 1589321 - RNA, 19 nt, Homo sapiens
agacgcagcugugugaaau

SEQ ID NO: 1589322 - RNA, 19 nt, Homo sapiens
uaaaugaagacaagcugaa

SEQ ID NO: 1589323 - RNA, 19 nt, Homo sapiens
gcgaggaagaucaacauau

SEQ ID NO: 1589324 - RNA, 19 nt, Homo sapiens
aauaugauuuggcgaggaa

SEQ ID NO: 1589325 - RNA, 19 nt, Homo sapiens
ggagagagaagaagaucag

SEQ ID NO: 1589326 - RNA, 19 nt, Homo sapiens
ggagcugucucagucaaag

SEQ ID NO: 1589327 - RNA, 19 nt, Homo sapiens
gagacgcagcugugugaaa

SEQ ID NO: 1589328 - RNA, 19 nt, Homo sapiens
caagaggaaccaccaacug

SEQ ID NO: 1589329 - RNA, 19 nt, Homo sapiens
guggaaaugguccugauga

SEQ ID NO: 1589330 - RNA, 19 nt, Homo sapiens
aagaggaaccaccaacuga

SEQ ID NO: 1589331 - RNA, 19 nt, Homo sapiens
gaggaagaucaacauauag

SEQ ID NO: 1589332 - RNA, 19 nt, Homo sapiens
caagcugaaacaacacaaa

SEQ ID NO: 1589333 - RNA, 19 nt, Homo sapiens
acgcagcugugugaaauau

SEQ ID NO: 1589334 - RNA, 19 nt, Homo sapiens
caggagcugucucagucaa

SEQ ID NO: 1589335 - RNA, 19 nt, Homo sapiens
ggaaccaccaacugaaagu

SEQ ID NO: 1589336 - RNA, 19 nt, Homo sapiens
gcaagaggaaccaccaacu

SEQ ID NO: 1589337 - RNA, 19 nt, Homo sapiens
gggugaauguggaaauggu

SEQ ID NO: 1589338 - RNA, 19 nt, Homo sapiens
aaaugaagacaagcugaaa

SEQ ID NO: 1589339 - RNA, 19 nt, Homo sapiens
ggcgaggaagaucaacaua

SEQ ID NO: 1589340 - RNA, 19 nt, Homo sapiens
agaggaaccaccaacugaa

SEQ ID NO: 1589341 - RNA, 19 nt, Homo sapiens
cugagacgcagcuguguga

SEQ ID NO: 1589342 - RNA, 19 nt, Homo sapiens
gaaccaccaacugaaaguc

SEQ ID NO: 1589343 - RNA, 19 nt, Homo sapiens
gacgcagcugugugaaaua

SEQ ID NO: 1589344 - RNA, 19 nt, Homo sapiens
ggaagaagauauagaccaa

SEQ ID NO: 1589345 - RNA, 19 nt, Homo sapiens
gaagaaccaccaacugaaa

SEQ ID NO: 1589346 - RNA, 19 nt, Homo sapiens
gaagggaaaccacagcuuu

SEQ ID NO: 1589347 - RNA, 19 nt, Homo sapiens
aaccacagcuuuaaacgaa

SEQ ID NO: 1589348 - RNA, 19 nt, Homo sapiens
gccagagccucaacaagaa

SEQ ID NO: 1589349 - RNA, 19 nt, Homo sapiens
acaauauucuggacugaaa

SEQ ID NO: 1589350 - RNA, 19 nt, Homo sapiens
gaagugcucaaguguggua

SEQ ID NO: 1589351 - RNA, 19 nt, Homo sapiens
ucaagugccuaaccuggaa

SEQ ID NO: 1589352 - RNA, 19 nt, Homo sapiens
aagaagauauagaccaaga

SEQ ID NO: 1589353 - RNA, 19 nt, Homo sapiens
ccacagcuuuaaacgaaga

SEQ ID NO: 1589354 - RNA, 19 nt, Homo sapiens
gaagagagaagaugaucag

SEQ ID NO: 1589355 - RNA, 19 nt, Homo sapiens
auucuggacugaaauauga

SEQ ID NO: 1589356 - RNA, 19 nt, Homo sapiens
gaucauacaccuggucaga

SEQ ID NO: 1589357 - RNA, 19 nt, Homo sapiens
aauaugaguuggcgaggaa

SEQ ID NO: 1589358 - RNA, 19 nt, Homo sapiens
ggaaaccacagcuuuaaac

SEQ ID NO: 1589359 - RNA, 19 nt, Homo sapiens
aagaagaaccaccaacuga

SEQ ID NO: 1589360 - RNA, 19 nt, Homo sapiens
gggaaaccacagcuuuaaa

SEQ ID NO: 1589361 - RNA, 19 nt, Homo sapiens
agacgauguuuacgacuug

SEQ ID NO: 1589362 - RNA, 19 nt, Homo sapiens
ucauacaccuggucagaag

SEQ ID NO: 1589363 - RNA, 19 nt, Homo sapiens
gaaugcaaacuggauuuau

SEQ ID NO: 1589364 - RNA, 19 nt, Homo sapiens
caagaagaaccaccaacug

SEQ ID NO: 1589365 - RNA, 19 nt, Homo sapiens
ugccagagccucaacaaga

SEQ ID NO: 1589366 - RNA, 19 nt, Homo sapiens
aaugcaaacuggauuuauc

SEQ ID NO: 1589367 - RNA, 19 nt, Homo sapiens
gaagacaaccaaaagaaug

SEQ ID NO: 1589368 - RNA, 19 nt, Homo sapiens
aagggaaaccacagcuuua

SEQ ID NO: 1589369 - RNA, 19 nt, Homo sapiens
ggagcugucucagucaaag

SEQ ID NO: 1589370 - RNA, 19 nt, Homo sapiens
ucacaauauucuggacuga

SEQ ID NO: 1589371 - RNA, 19 nt, Homo sapiens
agaaugcaaacuggauuua

SEQ ID NO: 1589372 - RNA, 19 nt, Homo sapiens
ggaagggaaaccacagcuu

SEQ ID NO: 1589373 - RNA, 19 nt, Homo sapiens
ggaugaaugcggagauagu

SEQ ID NO: 1589374 - RNA, 19 nt, Homo sapiens
gguauacacucaggugcau

SEQ ID NO: 1589375 - RNA, 19 nt, Homo sapiens
agaagaaccaccaacugaa

SEQ ID NO: 1589376 - RNA, 19 nt, Homo sapiens
caacaagaagaaccaccaa

SEQ ID NO: 1589377 - RNA, 19 nt, Homo sapiens
aagacgauguuuacgacuu

SEQ ID NO: 1589378 - RNA, 19 nt, Homo sapiens
uggcgaggaagaagauaua

SEQ ID NO: 1589379 - RNA, 19 nt, Homo sapiens
uauacacucaggugcauuu

SEQ ID NO: 1589380 - RNA, 19 nt, Homo sapiens
gggugcagcugagauucaa

SEQ ID NO: 1589381 - RNA, 19 nt, Homo sapiens
aaagaaugcaaacuggauu

SEQ ID NO: 1589382 - RNA, 19 nt, Homo sapiens
gcggagauaguccugaugu

SEQ ID NO: 1589383 - RNA, 19 nt, Homo sapiens
caggagcugucucagucaa

SEQ ID NO: 1589384 - RNA, 19 nt, Homo sapiens
agauauagaccaagacgau

SEQ ID NO: 1589385 - RNA, 19 nt, Homo sapiens
ggucagaagagagaagaug

SEQ ID NO: 1589386 - RNA, 19 nt, Homo sapiens
gcgaggaagaagauauaga

SEQ ID NO: 1589387 - RNA, 19 nt, Homo sapiens
gaaaccacagcuuuaaacg

SEQ ID NO: 1589388 - RNA, 19 nt, Homo sapiens
aagaaugcaaacuggauuu

SEQ ID NO: 1589389 - RNA, 19 nt, Homo sapiens
agaccaagacgauguuuac

SEQ ID NO: 1589390 - RNA, 19 nt, Homo sapiens
gucagaagagagaagauga

SEQ ID NO: 1589391 - RNA, 19 nt, Homo sapiens
cgaggaagaagauauagac

SEQ ID NO: 1589392 - RNA, 19 nt, Homo sapiens
gugcucaagugugguauac

SEQ ID NO: 1589393 - RNA, 19 nt, Homo sapiens
uagaccaagacgauguuua

SEQ ID NO: 1589394 - RNA, 19 nt, Homo sapiens
ggggaugaaugcggagaua

SEQ ID NO: 1589395 - RNA, 19 nt, Homo sapiens
aaaccacagcuuuaaacga

SEQ ID NO: 1589396 - RNA, 19 nt, Homo sapiens
gaugaaugcggagauaguc

SEQ ID NO: 1589397 - RNA, 19 nt, Homo sapiens
gaaagucaggaucauacac

SEQ ID NO: 1589398 - RNA, 19 nt, Homo sapiens
agggaaaccacagcuuuaa

SEQ ID NO: 1589399 - RNA, 19 nt, Homo sapiens
gaaccaccaacugaaaguc

SEQ ID NO: 1589400 - RNA, 19 nt, Homo sapiens
gcgcggaccuggaacauua

SEQ ID NO: 1589401 - RNA, 19 nt, Homo sapiens
agaagaagcugaacaaagu

SEQ ID NO: 1589402 - RNA, 19 nt, Homo sapiens
gaagagauucgacaagugu

SEQ ID NO: 1589403 - RNA, 19 nt, Homo sapiens
gagaagcugcucugucauu

SEQ ID NO: 1589404 - RNA, 19 nt, Homo sapiens
ugacuggacucuucaccaa

SEQ ID NO: 1589405 - RNA, 19 nt, Homo sapiens
caauggcacuggcuacuuc

SEQ ID NO: 1589406 - RNA, 19 nt, Homo sapiens
gacacaaccucaacaagca

SEQ ID NO: 1589407 - RNA, 19 nt, Homo sapiens
gaacaaagugagugacaag

SEQ ID NO: 1589408 - RNA, 19 nt, Homo sapiens
gcuccaagcccuguccuua

SEQ ID NO: 1589409 - RNA, 19 nt, Homo sapiens
cgacuggacccggacauua

SEQ ID NO: 1589410 - RNA, 19 nt, Homo sapiens
cagaggcgcucacucaagu

SEQ ID NO: 1589411 - RNA, 19 nt, Homo sapiens
acaacuaccuggcucugaa

SEQ ID NO: 1589412 - RNA, 19 nt, Homo sapiens
ucaaggugcugcuucuuag

SEQ ID NO: 1589413 - RNA, 19 nt, Homo sapiens
gaacagccaaggcaaguac

SEQ ID NO: 1589414 - RNA, 19 nt, Homo sapiens
gacuggacccggacauuaa

SEQ ID NO: 1589415 - RNA, 19 nt, Homo sapiens
gacaauaagagcugcaaga

SEQ ID NO: 1589416 - RNA, 19 nt, Homo sapiens
gucaaggugcugcuucuua

SEQ ID NO: 1589417 - RNA, 19 nt, Homo sapiens
gaaauaccgauccugcaau

SEQ ID NO: 1589418 - RNA, 19 nt, Homo sapiens
gaaccugggcuccaagaag

SEQ ID NO: 1589419 - RNA, 19 nt, Homo sapiens
cugcgacgcugcuucuauu

SEQ ID NO: 1589420 - RNA, 19 nt, Homo sapiens
aagaagagauucgacaagu

SEQ ID NO: 1589421 - RNA, 19 nt, Homo sapiens
ggacacugccauccucuuc

SEQ ID NO: 1589422 - RNA, 19 nt, Homo sapiens
aaccugggcuccaagaaga

SEQ ID NO: 1589423 - RNA, 19 nt, Homo sapiens
gaagcugcucugucauuga

SEQ ID NO: 1589424 - RNA, 19 nt, Homo sapiens
gcagaagaagcugaacaaa

SEQ ID NO: 1589425 - RNA, 19 nt, Homo sapiens
ccaagcguuucgugucuau

SEQ ID NO: 1589426 - RNA, 19 nt, Homo sapiens
ccaaaugggaucccuaugg

SEQ ID NO: 1589427 - RNA, 19 nt, Homo sapiens
ccuucuaucugcccaaaga

SEQ ID NO: 1589428 - RNA, 19 nt, Homo sapiens
ugaaauaccgauccugcaa

SEQ ID NO: 1589429 - RNA, 19 nt, Homo sapiens
cagaagaagcugaacaaag

SEQ ID NO: 1589430 - RNA, 19 nt, Homo sapiens
agaagagauucgacaagug

SEQ ID NO: 1589431 - RNA, 19 nt, Homo sapiens
gcacuggcuacuucuaugu

SEQ ID NO: 1589432 - RNA, 19 nt, Homo sapiens
cgacgcugcuucuauucug

SEQ ID NO: 1589433 - RNA, 19 nt, Homo sapiens
aaauaccgauccugcaauc

SEQ ID NO: 1589434 - RNA, 19 nt, Homo sapiens
gaagaagcugaacaaagug

SEQ ID NO: 1589435 - RNA, 19 nt, Homo sapiens
ccaagaagagauucgacaa

SEQ ID NO: 1589436 - RNA, 19 nt, Homo sapiens
guccuuacaugcaguacug

SEQ ID NO: 1589437 - RNA, 19 nt, Homo sapiens
ugaacaaagugagugacaa

SEQ ID NO: 1589438 - RNA, 19 nt, Homo sapiens
acaauaagagcugcaagaa

SEQ ID NO: 1589439 - RNA, 19 nt, Homo sapiens
gcaccaaccggcucacucu

SEQ ID NO: 1589440 - RNA, 19 nt, Homo sapiens
agaagcugcucugucauug

SEQ ID NO: 1589441 - RNA, 19 nt, Homo sapiens
ggcagaagaagcugaacaa

SEQ ID NO: 1589442 - RNA, 19 nt, Homo sapiens
acgagucaauggucaaguu

SEQ ID NO: 1589443 - RNA, 19 nt, Homo sapiens
ggcacuggcuacuucuaug

SEQ ID NO: 1589444 - RNA, 19 nt, Homo sapiens
caagcccuguccuuacaug

SEQ ID NO: 1589445 - RNA, 19 nt, Homo sapiens
gacccucugucuugcacaa

SEQ ID NO: 1589446 - RNA, 19 nt, Homo sapiens
ggagagacacaaccucaac

SEQ ID NO: 1589447 - RNA, 19 nt, Homo sapiens
gcaucaaggcuggcuguga

SEQ ID NO: 1589448 - RNA, 19 nt, Homo sapiens
gaugguuccugggccaaau

SEQ ID NO: 1589449 - RNA, 19 nt, Homo sapiens
gccaagcguuucgugucua

SEQ ID NO: 1589450 - RNA, 19 nt, Homo sapiens
caaguacuccggcgugucu

SEQ ID NO: 1589451 - RNA, 19 nt, Homo sapiens
gccggaugcucaguucuug

SEQ ID NO: 1589452 - RNA, 19 nt, Homo sapiens
caagaagagauucgacaag

SEQ ID NO: 1589453 - RNA, 19 nt, Homo sapiens
caauaagagcugcaagaag

SEQ ID NO: 1589454 - RNA, 19 nt, Homo sapiens
cagcucagccuccggaaag

SEQ ID NO: 1589455 - RNA, 19 nt, Homo sapiens
ggccaaaugggaucccuau

SEQ ID NO: 1589456 - RNA, 19 nt, Homo sapiens
gaaggccaagggacagaug

SEQ ID NO: 1589457 - RNA, 19 nt, Homo sapiens
uccaagcccuguccuuaca

SEQ ID NO: 1589458 - RNA, 19 nt, Homo sapiens
ggaccuggaacauuaucug

SEQ ID NO: 1589459 - RNA, 19 nt, Homo sapiens
gaucggggaugacaacuac

SEQ ID NO: 1589460 - RNA, 19 nt, Homo sapiens
aagcugcucugucauugag

SEQ ID NO: 1589461 - RNA, 19 nt, Homo sapiens
ugauguggguaccaugugu

SEQ ID NO: 1589462 - RNA, 19 nt, Homo sapiens
ggacaagugcaagcucauc

SEQ ID NO: 1589463 - RNA, 19 nt, Homo sapiens
ggagcagugugaggcuuuc

SEQ ID NO: 1589464 - RNA, 19 nt, Homo sapiens
gagagacacaaccucaaca

SEQ ID NO: 1589465 - RNA, 19 nt, Homo sapiens
gaagcugaacaaagugagu

SEQ ID NO: 1589466 - RNA, 19 nt, Homo sapiens
uuucagaggcgcucacuca

SEQ ID NO: 1589467 - RNA, 19 nt, Homo sapiens
gguccgcuacuccuucuau

SEQ ID NO: 1589468 - RNA, 19 nt, Homo sapiens
gcgagggagugagggugaa

SEQ ID NO: 1589469 - RNA, 19 nt, Homo sapiens
gacgccggaugcucaguuc

SEQ ID NO: 1589470 - RNA, 19 nt, Homo sapiens
ggaaccugggcuccaagaa

SEQ ID NO: 1589471 - RNA, 19 nt, Homo sapiens
ugacuccaccuccgucugu

SEQ ID NO: 1589472 - RNA, 19 nt, Homo sapiens
gagacacaaccucaacaag

SEQ ID NO: 1589473 - RNA, 19 nt, Homo sapiens
cuaccuggcucugaagaac

SEQ ID NO: 1589474 - RNA, 19 nt, Homo sapiens
gagcugggccacguguuca

SEQ ID NO: 1589475 - RNA, 19 nt, Homo sapiens
gacaacuaccuggcucuga

SEQ ID NO: 1589476 - RNA, 19 nt, Homo sapiens
ccaugacaaugugaaaguc

SEQ ID NO: 1589477 - RNA, 19 nt, Homo sapiens
gcugauguggguaccaugu

SEQ ID NO: 1589478 - RNA, 19 nt, Homo sapiens
caaggugcugcuucuuaga

SEQ ID NO: 1589479 - RNA, 19 nt, Homo sapiens
gaacagaagaggcagauua

SEQ ID NO: 1589480 - RNA, 19 nt, Homo sapiens
gaggauagccguaauguuu

SEQ ID NO: 1589481 - RNA, 19 nt, Homo sapiens
ggacacaacuuuggcauga

SEQ ID NO: 1589482 - RNA, 19 nt, Homo sapiens
ggacuggccuucaccauug

SEQ ID NO: 1589483 - RNA, 19 nt, Homo sapiens
cauaagcgcucucuucuga

SEQ ID NO: 1589484 - RNA, 19 nt, Homo sapiens
gcaaugcccucagaaggua

SEQ ID NO: 1589485 - RNA, 19 nt, Homo sapiens
ggaaggaaaugugagacua

SEQ ID NO: 1589486 - RNA, 19 nt, Homo sapiens
caaagccugugaaggaaua

SEQ ID NO: 1589487 - RNA, 19 nt, Homo sapiens
ggaaaugugagacuaaauu

SEQ ID NO: 1589488 - RNA, 19 nt, Homo sapiens
gccaguaucuacacaaauu

SEQ ID NO: 1589489 - RNA, 19 nt, Homo sapiens
caugguaucugcuuuauuc

SEQ ID NO: 1589490 - RNA, 19 nt, Homo sapiens
gcuggugccuugcaaagua

SEQ ID NO: 1589491 - RNA, 19 nt, Homo sapiens
ggacuucuguuucuaucaa

SEQ ID NO: 1589492 - RNA, 19 nt, Homo sapiens
gcgauuacgugucccauga

SEQ ID NO: 1589493 - RNA, 19 nt, Homo sapiens
gguaucugcuuuauucaaa

SEQ ID NO: 1589494 - RNA, 19 nt, Homo sapiens
caacaugguaucugcuuua

SEQ ID NO: 1589495 - RNA, 19 nt, Homo sapiens
gaucaggacuuaugcaaac

SEQ ID NO: 1589496 - RNA, 19 nt, Homo sapiens
acaaguauccugagaaauu

SEQ ID NO: 1589497 - RNA, 19 nt, Homo sapiens
ggaggaaacaucaacauug

SEQ ID NO: 1589498 - RNA, 19 nt, Homo sapiens
gaaggaaaugugagacuaa

SEQ ID NO: 1589499 - RNA, 19 nt, Homo sapiens
caucaacauugcaauugua

SEQ ID NO: 1589500 - RNA, 19 nt, Homo sapiens
ugacuggucuggauauaug

SEQ ID NO: 1589501 - RNA, 19 nt, Homo sapiens
gcagaccacaccuuaagua

SEQ ID NO: 1589502 - RNA, 19 nt, Homo sapiens
caugggagcuggcacauca

SEQ ID NO: 1589503 - RNA, 19 nt, Homo sapiens
caaccaguauuaucacaug

SEQ ID NO: 1589504 - RNA, 19 nt, Homo sapiens
aguagaagaucaggacuua

SEQ ID NO: 1589505 - RNA, 19 nt, Homo sapiens
gaggacagugugugaaaua

SEQ ID NO: 1589506 - RNA, 19 nt, Homo sapiens
caaguauccugagaaauug

SEQ ID NO: 1589507 - RNA, 19 nt, Homo sapiens
ccuaguggcuccuggcuuu

SEQ ID NO: 1589508 - RNA, 19 nt, Homo sapiens
uaacucagccugcacgauu

SEQ ID NO: 1589509 - RNA, 19 nt, Homo sapiens
uaaguggaauguguaguaa

SEQ ID NO: 1589510 - RNA, 19 nt, Homo sapiens
ggaagaaugagcccuguga

SEQ ID NO: 1589511 - RNA, 19 nt, Homo sapiens
ccacgcagaccacaccuua

SEQ ID NO: 1589512 - RNA, 19 nt, Homo sapiens
ggaaagacaggcacuaagu

SEQ ID NO: 1589513 - RNA, 19 nt, Homo sapiens
ggaaggaacccggguguug

SEQ ID NO: 1589514 - RNA, 19 nt, Homo sapiens
gaggaaacaucaacauugc

SEQ ID NO: 1589515 - RNA, 19 nt, Homo sapiens
gaucugaugcuguugaaga

SEQ ID NO: 1589516 - RNA, 19 nt, Homo sapiens
cuacagagaccugaaguuu

SEQ ID NO: 1589517 - RNA, 19 nt, Homo sapiens
ccauagaaaugaagaacug

SEQ ID NO: 1589518 - RNA, 19 nt, Homo sapiens
uaugcaaacucuacuguau

SEQ ID NO: 1589519 - RNA, 19 nt, Homo sapiens
ccaggagaauuauaugaug

SEQ ID NO: 1589520 - RNA, 19 nt, Homo sapiens
cuacacaaauuucuaagca

SEQ ID NO: 1589521 - RNA, 19 nt, Homo sapiens
acacaacuuuggcaugauu

SEQ ID NO: 1589522 - RNA, 19 nt, Homo sapiens
ggaaacaucaacauugcaa

SEQ ID NO: 1589523 - RNA, 19 nt, Homo sapiens
guggaagacgcaagaaaua

SEQ ID NO: 1589524 - RNA, 19 nt, Homo sapiens
gacagugugugaaauaugg

SEQ ID NO: 1589525 - RNA, 19 nt, Homo sapiens
gaccacaccuuaaguagcu

SEQ ID NO: 1589526 - RNA, 19 nt, Homo sapiens
gauuacgugucccaugaaa

SEQ ID NO: 1589527 - RNA, 19 nt, Homo sapiens
agaggcagauuacuuccua

SEQ ID NO: 1589528 - RNA, 19 nt, Homo sapiens
gaaaugaacgucucuaccu

SEQ ID NO: 1589529 - RNA, 19 nt, Homo sapiens
ggauagccguaauguuugu

SEQ ID NO: 1589530 - RNA, 19 nt, Homo sapiens
gugcagacguugggaaaga

SEQ ID NO: 1589531 - RNA, 19 nt, Homo sapiens
ugugaaauauggugaugaa

SEQ ID NO: 1589532 - RNA, 19 nt, Homo sapiens
ggaguauccgcaucuauga

SEQ ID NO: 1589533 - RNA, 19 nt, Homo sapiens
gcugcacgauuaaugaaga

SEQ ID NO: 1589534 - RNA, 19 nt, Homo sapiens
gcagcugcacgauuaauga

SEQ ID NO: 1589535 - RNA, 19 nt, Homo sapiens
ggagcgagguugacuagcu

SEQ ID NO: 1589536 - RNA, 19 nt, Homo sapiens
uacagacgguccuauaaug

SEQ ID NO: 1589537 - RNA, 19 nt, Homo sapiens
guauagaugggauauguga

SEQ ID NO: 1589538 - RNA, 19 nt, Homo sapiens
gcacaacagcagacgauuc

SEQ ID NO: 1589539 - RNA, 19 nt, Homo sapiens
gcaauuguaggucugauuc

SEQ ID NO: 1589540 - RNA, 19 nt, Homo sapiens
ggaagacgcaagaaauaca

SEQ ID NO: 1589541 - RNA, 19 nt, Homo sapiens
cuucacaccucucauggaa

SEQ ID NO: 1589542 - RNA, 19 nt, Homo sapiens
gagagagggcugcuacaga

SEQ ID NO: 1589543 - RNA, 19 nt, Homo sapiens
cguaauguuuguauagaug

SEQ ID NO: 1589544 - RNA, 19 nt, Homo sapiens
gccuuacacucaaguagaa

SEQ ID NO: 1589545 - RNA, 19 nt, Homo sapiens
gccaaagccugugaaggaa

SEQ ID NO: 1589546 - RNA, 19 nt, Homo sapiens
cagaagaggcagauuacuu

SEQ ID NO: 1589547 - RNA, 19 nt, Homo sapiens
auaaugagcccgagaacuu

SEQ ID NO: 1589548 - RNA, 19 nt, Homo sapiens
gaaagacaggcacuaaguc

SEQ ID NO: 1589549 - RNA, 19 nt, Homo sapiens
gcacuacuuucgacuacag

SEQ ID NO: 1589550 - RNA, 19 nt, Homo sapiens
ucaaggcucuuugcgauca

SEQ ID NO: 1589551 - RNA, 19 nt, Homo sapiens
ggacuuaugcaaacucuac

SEQ ID NO: 1589552 - RNA, 19 nt, Homo sapiens
uagaagaucaggacuuaug

SEQ ID NO: 1589553 - RNA, 19 nt, Homo sapiens
caacagcagacgauucaga

SEQ ID NO: 1589554 - RNA, 19 nt, Homo sapiens
ggaggacagugugugaaau

SEQ ID NO: 1589555 - RNA, 19 nt, Homo sapiens
gcagcagaaggcacaauuu

SEQ ID NO: 1589556 - RNA, 19 nt, Homo sapiens
uaaugagcccgagaacuua

SEQ ID NO: 1589557 - RNA, 19 nt, Homo sapiens
gaagggaacaugugcaaaa

SEQ ID NO: 1589558 - RNA, 19 nt, Homo sapiens
gagaagggaacaugugcaa

SEQ ID NO: 1589559 - RNA, 19 nt, Homo sapiens
cagcagaaggcacaauuug

SEQ ID NO: 1589560 - RNA, 19 nt, Homo sapiens
ggacagugugugaaauaug

SEQ ID NO: 1589561 - RNA, 19 nt, Homo sapiens
gcccuguggugccaucgua

SEQ ID NO: 1589562 - RNA, 19 nt, Homo sapiens
gacuacagacgguccuaua

SEQ ID NO: 1589563 - RNA, 19 nt, Homo sapiens
gucucuaccuccuacauuu

SEQ ID NO: 1589564 - RNA, 19 nt, Homo sapiens
cagaugaguauaagucuug

SEQ ID NO: 1589565 - RNA, 19 nt, Homo sapiens
ucacaccucucauggaaac

SEQ ID NO: 1589566 - RNA, 19 nt, Homo sapiens
guggaagccuuacacucaa

SEQ ID NO: 1589567 - RNA, 19 nt, Homo sapiens
gggaggacagugugugaaa

SEQ ID NO: 1589568 - RNA, 19 nt, Homo sapiens
gcaaacacacagugcaagu

SEQ ID NO: 1589569 - RNA, 19 nt, Homo sapiens
gaaaugaagaacugaacgu

SEQ ID NO: 1589570 - RNA, 19 nt, Homo sapiens
acaauguccuuggaucuga

SEQ ID NO: 1589571 - RNA, 19 nt, Homo sapiens
gagcacaacagcagacgau

SEQ ID NO: 1589572 - RNA, 19 nt, Homo sapiens
auaaguggaauguguagua

SEQ ID NO: 1589573 - RNA, 19 nt, Homo sapiens
gguugagucucuucaccuu

SEQ ID NO: 1589574 - RNA, 19 nt, Homo sapiens
ucaacaugguaucugcuuu

SEQ ID NO: 1589575 - RNA, 19 nt, Homo sapiens
gaggacuucuguuucuauc

SEQ ID NO: 1589576 - RNA, 19 nt, Homo sapiens
acacucaaguagaagauca

SEQ ID NO: 1589577 - RNA, 19 nt, Homo sapiens
aaggaaaugugagacuaaa

SEQ ID NO: 1589578 - RNA, 19 nt, Homo sapiens
ggagaauuauaugaugcaa

SEQ ID NO: 1589579 - RNA, 19 nt, Homo sapiens
cgaccaagauuauggaauu

SEQ ID NO: 1589580 - RNA, 19 nt, Homo sapiens
ggagacacauccugcaaga

SEQ ID NO: 1589581 - RNA, 19 nt, Homo sapiens
gcagaaacauggagcaucu

SEQ ID NO: 1589582 - RNA, 19 nt, Homo sapiens
gcacaacuguucgcuaugu

SEQ ID NO: 1589583 - RNA, 19 nt, Homo sapiens
gaacaugguauacaauaug

SEQ ID NO: 1589584 - RNA, 19 nt, Homo sapiens
ccacaacucuggugaacga

SEQ ID NO: 1589585 - RNA, 19 nt, Homo sapiens
gcagggacuucuaugcaaa

SEQ ID NO: 1589586 - RNA, 19 nt, Homo sapiens
ggacuucuaugcaaacaag

SEQ ID NO: 1589587 - RNA, 19 nt, Homo sapiens
gguggaugcugcuguguuu

SEQ ID NO: 1589588 - RNA, 19 nt, Homo sapiens
ggaggugugugcagugcua

SEQ ID NO: 1589589 - RNA, 19 nt, Homo sapiens
gaacaugagcguggacuug

SEQ ID NO: 1589590 - RNA, 19 nt, Homo sapiens
ccacgacgaugaccacuca

SEQ ID NO: 1589591 - RNA, 19 nt, Homo sapiens
gagaugaccuugaaaacuu

SEQ ID NO: 1589592 - RNA, 19 nt, Homo sapiens
gaagaaaggccugcugaca

SEQ ID NO: 1589593 - RNA, 19 nt, Homo sapiens
gaacccaagugaccucucu

SEQ ID NO: 1589594 - RNA, 19 nt, Homo sapiens
uggaauugcuuacuuagga

SEQ ID NO: 1589595 - RNA, 19 nt, Homo sapiens
gcaggacucuuuguucauc

SEQ ID NO: 1589596 - RNA, 19 nt, Homo sapiens
aaacauggagcaucuaaug

SEQ ID NO: 1589597 - RNA, 19 nt, Homo sapiens
acaagaauccaacugcaua

SEQ ID NO: 1589598 - RNA, 19 nt, Homo sapiens
caucgggucugcagccaaa

SEQ ID NO: 1589599 - RNA, 19 nt, Homo sapiens
ugacagccguggugguuga

SEQ ID NO: 1589600 - RNA, 19 nt, Homo sapiens
cagccgagaugaccuugaa

SEQ ID NO: 1589601 - RNA, 19 nt, Homo sapiens
cgcgauaccucggcaauaa

SEQ ID NO: 1589602 - RNA, 19 nt, Homo sapiens
ccaagggucugcccagcuu

SEQ ID NO: 1589603 - RNA, 19 nt, Homo sapiens
gcaugaaccacgacgauga

SEQ ID NO: 1589604 - RNA, 19 nt, Homo sapiens
gaccaagcuuguccugcua

SEQ ID NO: 1589605 - RNA, 19 nt, Homo sapiens
ggccacaacuugggcauga

SEQ ID NO: 1589606 - RNA, 19 nt, Homo sapiens
ggucucaauuuggccuuua

SEQ ID NO: 1589607 - RNA, 19 nt, Homo sapiens
gcucugaccuacaaaugca

SEQ ID NO: 1589608 - RNA, 19 nt, Homo sapiens
caagggaccaaccaaacua

SEQ ID NO: 1589609 - RNA, 19 nt, Homo sapiens
gaauccaacugcauagaac

SEQ ID NO: 1589610 - RNA, 19 nt, Homo sapiens
gcacuugaugguguuguua

SEQ ID NO: 1589611 - RNA, 19 nt, Homo sapiens
ccaacugcauagaacauga

SEQ ID NO: 1589612 - RNA, 19 nt, Homo sapiens
aaucaaagcgaaccagaaa

SEQ ID NO: 1589613 - RNA, 19 nt, Homo sapiens
uguuggaauugcuuacuua

SEQ ID NO: 1589614 - RNA, 19 nt, Homo sapiens
ccgcaggacucuuuguuca

SEQ ID NO: 1589615 - RNA, 19 nt, Homo sapiens
gauaagccaugugaacucu

SEQ ID NO: 1589616 - RNA, 19 nt, Homo sapiens
gaaccaucgucucguguac

SEQ ID NO: 1589617 - RNA, 19 nt, Homo sapiens
gcuggcaggucccacauca

SEQ ID NO: 1589618 - RNA, 19 nt, Homo sapiens
gacaacgucccgcuaaguu

SEQ ID NO: 1589619 - RNA, 19 nt, Homo sapiens
gccaggacaugcgguggua

SEQ ID NO: 1589620 - RNA, 19 nt, Homo sapiens
aggcacaacuguucgcuau

SEQ ID NO: 1589621 - RNA, 19 nt, Homo sapiens
gauccuguuuggcaugaau

SEQ ID NO: 1589622 - RNA, 19 nt, Homo sapiens
ggacgagaacaucugauca

SEQ ID NO: 1589623 - RNA, 19 nt, Homo sapiens
gaccaagauuauggaauuc

SEQ ID NO: 1589624 - RNA, 19 nt, Homo sapiens
caaacuaccgcugcacuug

SEQ ID NO: 1589625 - RNA, 19 nt, Homo sapiens
cauggagcaucuaaugugu

SEQ ID NO: 1589626 - RNA, 19 nt, Homo sapiens
ccgccgagcugugcuucua

SEQ ID NO: 1589627 - RNA, 19 nt, Homo sapiens
cgagaccaguggacgguau

SEQ ID NO: 1589628 - RNA, 19 nt, Homo sapiens
gcagugccagauccuguuu

SEQ ID NO: 1589629 - RNA, 19 nt, Homo sapiens
cauuaugaauacacuguuc

SEQ ID NO: 1589630 - RNA, 19 nt, Homo sapiens
ccaagauuauggaauucau

SEQ ID NO: 1589631 - RNA, 19 nt, Homo sapiens
guuguuauuucacgaccaa

SEQ ID NO: 1589632 - RNA, 19 nt, Homo sapiens
caucugaucaggcgcaaau

SEQ ID NO: 1589633 - RNA, 19 nt, Homo sapiens
cagaagccagcacacagua

SEQ ID NO: 1589634 - RNA, 19 nt, Homo sapiens
cuggagagcuucugucacu

SEQ ID NO: 1589635 - RNA, 19 nt, Homo sapiens
ccgcuaaguuguccauugg

SEQ ID NO: 1589636 - RNA, 19 nt, Homo sapiens
agaaacauggagcaucuaa

SEQ ID NO: 1589637 - RNA, 19 nt, Homo sapiens
acaaagaugaaccguguga

SEQ ID NO: 1589638 - RNA, 19 nt, Homo sapiens
aaacuaccgcugcacuuga

SEQ ID NO: 1589639 - RNA, 19 nt, Homo sapiens
gaaacauggagcaucuaau

SEQ ID NO: 1589640 - RNA, 19 nt, Homo sapiens
gacaauggucucaauuugg

SEQ ID NO: 1589641 - RNA, 19 nt, Homo sapiens
uaagccaugugaacucuac

SEQ ID NO: 1589642 - RNA, 19 nt, Homo sapiens
gagaccaguggacgguaua

SEQ ID NO: 1589643 - RNA, 19 nt, Homo sapiens
uugcugcucugaccuacaa

SEQ ID NO: 1589644 - RNA, 19 nt, Homo sapiens
ucaggcagaggaaauguga

SEQ ID NO: 1589645 - RNA, 19 nt, Homo sapiens
gugcuaagaggaagugugu

SEQ ID NO: 1589646 - RNA, 19 nt, Homo sapiens
gaaccucugccaggacaug

SEQ ID NO: 1589647 - RNA, 19 nt, Homo sapiens
ucaacaagaccacaacucu

SEQ ID NO: 1589648 - RNA, 19 nt, Homo sapiens
acgccgacauggugcagua

SEQ ID NO: 1589649 - RNA, 19 nt, Homo sapiens
cagauccuguuuggcauga

SEQ ID NO: 1589650 - RNA, 19 nt, Homo sapiens
gcgcgauaccucggcaaua

SEQ ID NO: 1589651 - RNA, 19 nt, Homo sapiens
gcagaacgaggaguaugga

SEQ ID NO: 1589652 - RNA, 19 nt, Homo sapiens
ggcgcgaccuguaccuuca

SEQ ID NO: 1589653 - RNA, 19 nt, Homo sapiens
gguaagggguccaucaaca

SEQ ID NO: 1589654 - RNA, 19 nt, Homo sapiens
caccaacucacaagggaaa

SEQ ID NO: 1589655 - RNA, 19 nt, Homo sapiens
uugaugguguuguuauuuc

SEQ ID NO: 1589656 - RNA, 19 nt, Homo sapiens
ccguggugguugacgauaa

SEQ ID NO: 1589657 - RNA, 19 nt, Homo sapiens
agaauccaacugcauagaa

SEQ ID NO: 1589658 - RNA, 19 nt, Homo sapiens
gguccgaaggugcaacuug

SEQ ID NO: 1589659 - RNA, 19 nt, Homo sapiens
aaagaugaaccgugugaca

SEQ ID NO: 1589660 - RNA, 19 nt, Homo sapiens
ggaugcugcuguguuugug

SEQ ID NO: 1589661 - RNA, 19 nt, Homo sapiens
cccauucaguggacgagaa

SEQ ID NO: 1589662 - RNA, 19 nt, Homo sapiens
uauuucacgaccaagauua

SEQ ID NO: 1589663 - RNA, 19 nt, Homo sapiens
ugaugguguuguuauuuca

SEQ ID NO: 1589664 - RNA, 19 nt, Homo sapiens
gcagaggaaaugugacaac

SEQ ID NO: 1589665 - RNA, 19 nt, Homo sapiens
gagcaugugcagccgaaca

SEQ ID NO: 1589666 - RNA, 19 nt, Homo sapiens
gaaaggccggaacccaagu

SEQ ID NO: 1589667 - RNA, 19 nt, Homo sapiens
gggcaugaaccacgacgau

SEQ ID NO: 1589668 - RNA, 19 nt, Homo sapiens
uaagaggaagugugugcuu

SEQ ID NO: 1589669 - RNA, 19 nt, Homo sapiens
caagaauccaacugcauag

SEQ ID NO: 1589670 - RNA, 19 nt, Homo sapiens
ccggagaguuccagauugc

SEQ ID NO: 1589671 - RNA, 19 nt, Homo sapiens
gacgauaagccaugugaac

SEQ ID NO: 1589672 - RNA, 19 nt, Homo sapiens
uggcaggucccacaucaug

SEQ ID NO: 1589673 - RNA, 19 nt, Homo sapiens
ccuuuaccaucgcccauga

SEQ ID NO: 1589674 - RNA, 19 nt, Homo sapiens
gaccugcagggacuucuau

SEQ ID NO: 1589675 - RNA, 19 nt, Homo sapiens
gcucugcaagguucuaaca

SEQ ID NO: 1589676 - RNA, 19 nt, Homo sapiens
ccaaacuaccgcugcacuu

SEQ ID NO: 1589677 - RNA, 19 nt, Homo sapiens
gugcugcugcugcugguuu

SEQ ID NO: 1589678 - RNA, 19 nt, Homo sapiens
cccgcuaaguuguccauug

SEQ ID NO: 1589679 - RNA, 19 nt, Homo sapiens
gaacugcacuuagaacuua

SEQ ID NO: 1589680 - RNA, 19 nt, Homo sapiens
gaagguuucuggccuauuu

SEQ ID NO: 1589681 - RNA, 19 nt, Homo sapiens
acaagaaccuggaggauua

SEQ ID NO: 1589682 - RNA, 19 nt, Homo sapiens
gaagaucgaugcaaacugu

SEQ ID NO: 1589683 - RNA, 19 nt, Homo sapiens
uaucagcugugcaauauua

SEQ ID NO: 1589684 - RNA, 19 nt, Homo sapiens
gccaguaucucaagaaauu

SEQ ID NO: 1589685 - RNA, 19 nt, Homo sapiens
gcacaacuuugguaugauu

SEQ ID NO: 1589686 - RNA, 19 nt, Homo sapiens
gaaacccugucucuacuaa

SEQ ID NO: 1589687 - RNA, 19 nt, Homo sapiens
gggcacaacuuugguauga

SEQ ID NO: 1589688 - RNA, 19 nt, Homo sapiens
gaaguuguaccaucaauga

SEQ ID NO: 1589689 - RNA, 19 nt, Homo sapiens
gaucaugccaucuuacuaa

SEQ ID NO: 1589690 - RNA, 19 nt, Homo sapiens
gacaggaacugcacuuaga

SEQ ID NO: 1589691 - RNA, 19 nt, Homo sapiens
ccacauacauucucacagu

SEQ ID NO: 1589692 - RNA, 19 nt, Homo sapiens
uaucagggauuuaucagaa

SEQ ID NO: 1589693 - RNA, 19 nt, Homo sapiens
gaauauaacagcaaaccuu

SEQ ID NO: 1589694 - RNA, 19 nt, Homo sapiens
cagaaaggcugaaggcaau

SEQ ID NO: 1589695 - RNA, 19 nt, Homo sapiens
gggaugugaucaugaacua

SEQ ID NO: 1589696 - RNA, 19 nt, Homo sapiens
guauaaauauccggacaaa

SEQ ID NO: 1589697 - RNA, 19 nt, Homo sapiens
gaaccuggaggauuauuga

SEQ ID NO: 1589698 - RNA, 19 nt, Homo sapiens
guucgaagccucagucaaa

SEQ ID NO: 1589699 - RNA, 19 nt, Homo sapiens
caccaucgcucaugaguca

SEQ ID NO: 1589700 - RNA, 19 nt, Homo sapiens
agaggaagaucgaugcaaa

SEQ ID NO: 1589701 - RNA, 19 nt, Homo sapiens
gaaagaauggcaagagaca

SEQ ID NO: 1589702 - RNA, 19 nt, Homo sapiens
gccgaaagauccagugugu

SEQ ID NO: 1589703 - RNA, 19 nt, Homo sapiens
caaacuaccaggacagauu

SEQ ID NO: 1589704 - RNA, 19 nt, Homo sapiens
aagcaggacaguauaaaua

SEQ ID NO: 1589705 - RNA, 19 nt, Homo sapiens
gagccuaauucuucuggaa

SEQ ID NO: 1589706 - RNA, 19 nt, Homo sapiens
ucaagucaauuccucauuc

SEQ ID NO: 1589707 - RNA, 19 nt, Homo sapiens
gaacuccaccagccacaaa

SEQ ID NO: 1589708 - RNA, 19 nt, Homo sapiens
uugcaaaggugauaauuca

SEQ ID NO: 1589709 - RNA, 19 nt, Homo sapiens
cugcaaggcugagaacuuu

SEQ ID NO: 1589710 - RNA, 19 nt, Homo sapiens
ucaacagugugcagaauau

SEQ ID NO: 1589711 - RNA, 19 nt, Homo sapiens
ggaagaaugaaccauguga

SEQ ID NO: 1589712 - RNA, 19 nt, Homo sapiens
caggagagacacugcaaua

SEQ ID NO: 1589713 - RNA, 19 nt, Homo sapiens
ggacgacgcaagaaauaug

SEQ ID NO: 1589714 - RNA, 19 nt, Homo sapiens
ucagccgggucauauauuu

SEQ ID NO: 1589715 - RNA, 19 nt, Homo sapiens
gcugagaacuuugaauuuu

SEQ ID NO: 1589716 - RNA, 19 nt, Homo sapiens
gcaggacaguauaaauauc

SEQ ID NO: 1589717 - RNA, 19 nt, Homo sapiens
caagcaagcaggacaguau

SEQ ID NO: 1589718 - RNA, 19 nt, Homo sapiens
gcaaggcugagaacuuuga

SEQ ID NO: 1589719 - RNA, 19 nt, Homo sapiens
guuuguggcuugaguaugu

SEQ ID NO: 1589720 - RNA, 19 nt, Homo sapiens
ggugugagaccaaguuuau

SEQ ID NO: 1589721 - RNA, 19 nt, Homo sapiens
ggaguaucgugcagucaga

SEQ ID NO: 1589722 - RNA, 19 nt, Homo sapiens
uauuaacccuugcaaugaa

SEQ ID NO: 1589723 - RNA, 19 nt, Homo sapiens
gcaauguccggcaaaguga

SEQ ID NO: 1589724 - RNA, 19 nt, Homo sapiens
uaaauauccggacaaacua

SEQ ID NO: 1589725 - RNA, 19 nt, Homo sapiens
ccaguggaaugugcucuaa

SEQ ID NO: 1589726 - RNA, 19 nt, Homo sapiens
ggaauuauccugguuacuc

SEQ ID NO: 1589727 - RNA, 19 nt, Homo sapiens
agggauagcuuggaaguau

SEQ ID NO: 1589728 - RNA, 19 nt, Homo sapiens
gcaagcaggacaguauaaa

SEQ ID NO: 1589729 - RNA, 19 nt, Homo sapiens
ggacaggaacugcacuuag

SEQ ID NO: 1589730 - RNA, 19 nt, Homo sapiens
cauucucucuguccaguaa

SEQ ID NO: 1589731 - RNA, 19 nt, Homo sapiens
ggaccacguuugaauacca

SEQ ID NO: 1589732 - RNA, 19 nt, Homo sapiens
caaccagcauaaagcaaau

SEQ ID NO: 1589733 - RNA, 19 nt, Homo sapiens
gagagacacugcaauaacc

SEQ ID NO: 1589734 - RNA, 19 nt, Homo sapiens
gcggauuaaaugaugauua

SEQ ID NO: 1589735 - RNA, 19 nt, Homo sapiens
cggauuaaaugaugauuac

SEQ ID NO: 1589736 - RNA, 19 nt, Homo sapiens
ccacagaggacaccuaucu

SEQ ID NO: 1589737 - RNA, 19 nt, Homo sapiens
ggugauaauucaacuugca

SEQ ID NO: 1589738 - RNA, 19 nt, Homo sapiens
gaacuagugggaugugauc

SEQ ID NO: 1589739 - RNA, 19 nt, Homo sapiens
accagucucugaauaguuu

SEQ ID NO: 1589740 - RNA, 19 nt, Homo sapiens
guggugagccuaauucuuc

SEQ ID NO: 1589741 - RNA, 19 nt, Homo sapiens
ucacuuuauuguccaggua

SEQ ID NO: 1589742 - RNA, 19 nt, Homo sapiens
gguggagguuacauaaaug

SEQ ID NO: 1589743 - RNA, 19 nt, Homo sapiens
aauauuaacccuugcaaug

SEQ ID NO: 1589744 - RNA, 19 nt, Homo sapiens
uuuaucagcugugcaauau

SEQ ID NO: 1589745 - RNA, 19 nt, Homo sapiens
ggagagacacugcaauaac

SEQ ID NO: 1589746 - RNA, 19 nt, Homo sapiens
ggacuuggccuugccuuca

SEQ ID NO: 1589747 - RNA, 19 nt, Homo sapiens
gaacaagaaccuggaggau

SEQ ID NO: 1589748 - RNA, 19 nt, Homo sapiens
ucacaguaaugaagguuuc

SEQ ID NO: 1589749 - RNA, 19 nt, Homo sapiens
cacauacauucucacagua

SEQ ID NO: 1589750 - RNA, 19 nt, Homo sapiens
ggacagcagaggagaagau

SEQ ID NO: 1589751 - RNA, 19 nt, Homo sapiens
gaaaagauggugcuucaga

SEQ ID NO: 1589752 - RNA, 19 nt, Homo sapiens
ggaacugcacuuagaacuu

SEQ ID NO: 1589753 - RNA, 19 nt, Homo sapiens
gcucaacagugugcagaau

SEQ ID NO: 1589754 - RNA, 19 nt, Homo sapiens
aaacuaccaggacagauuu

SEQ ID NO: 1589755 - RNA, 19 nt, Homo sapiens
uggaaagaauggcaagaga

SEQ ID NO: 1589756 - RNA, 19 nt, Homo sapiens
acagaggacaccuaucuaa

SEQ ID NO: 1589757 - RNA, 19 nt, Homo sapiens
uggcuugucagguuuaaua

SEQ ID NO: 1589758 - RNA, 19 nt, Homo sapiens
cgccagggcccacaaauga

SEQ ID NO: 1589759 - RNA, 19 nt, Homo sapiens
cagcauaaagcaaaugaau

SEQ ID NO: 1589760 - RNA, 19 nt, Homo sapiens
ggcauauucuguccagguu

SEQ ID NO: 1589761 - RNA, 19 nt, Homo sapiens
gccagcggauuaaaugaug

SEQ ID NO: 1589762 - RNA, 19 nt, Homo sapiens
cuuaagcccucggcgauuu

SEQ ID NO: 1589763 - RNA, 19 nt, Homo sapiens
ggagcgagguauggauuag

SEQ ID NO: 1589764 - RNA, 19 nt, Homo sapiens
gccauuugcuugcgagauc

SEQ ID NO: 1589765 - RNA, 19 nt, Homo sapiens
auaaaggccuguaccucaa

SEQ ID NO: 1589766 - RNA, 19 nt, Homo sapiens
caaaggugauaauucaacu

SEQ ID NO: 1589767 - RNA, 19 nt, Homo sapiens
caacagugugcagaauaua

SEQ ID NO: 1589768 - RNA, 19 nt, Homo sapiens
uaccgaaguuguaccauca

SEQ ID NO: 1589769 - RNA, 19 nt, Homo sapiens
ccuggaggauuauugauca

SEQ ID NO: 1589770 - RNA, 19 nt, Homo sapiens
gaagcaguguugcauucuc

SEQ ID NO: 1589771 - RNA, 19 nt, Homo sapiens
caagucaauuccucauucu

SEQ ID NO: 1589772 - RNA, 19 nt, Homo sapiens
ugguggagguuacauaaau

SEQ ID NO: 1589773 - RNA, 19 nt, Homo sapiens
gcaaaggugauaauucaac

SEQ ID NO: 1589774 - RNA, 19 nt, Homo sapiens
ugugaaggauauuugcaaa

SEQ ID NO: 1589775 - RNA, 19 nt, Homo sapiens
uaccaggacagauuuauga

SEQ ID NO: 1589776 - RNA, 19 nt, Homo sapiens
gaaaggcugaaggcaauau

SEQ ID NO: 1589777 - RNA, 19 nt, Homo sapiens
ugaaccaugugacacucua

SEQ ID NO: 1589778 - RNA, 19 nt, Homo sapiens
aaagaugggacuauuggaa

SEQ ID NO: 1589779 - RNA, 19 nt, Homo sapiens
gcacucuacugcuuauuaa

SEQ ID NO: 1589780 - RNA, 19 nt, Homo sapiens
caacugcaauccuucauga

SEQ ID NO: 1589781 - RNA, 19 nt, Homo sapiens
gcacuaagcagucucaaga

SEQ ID NO: 1589782 - RNA, 19 nt, Homo sapiens
aaaccaacuugucauguaa

SEQ ID NO: 1589783 - RNA, 19 nt, Homo sapiens
cauuugagcuucagauuuc

SEQ ID NO: 1589784 - RNA, 19 nt, Homo sapiens
guaaaacacucaccagauu

SEQ ID NO: 1589785 - RNA, 19 nt, Homo sapiens
ggaacugcuuucuguguug

SEQ ID NO: 1589786 - RNA, 19 nt, Homo sapiens
caaagcauggcaagacaua

SEQ ID NO: 1589787 - RNA, 19 nt, Homo sapiens
gaaaugcacuaagcagucu

SEQ ID NO: 1589788 - RNA, 19 nt, Homo sapiens
gaggagagcauuugagcuu

SEQ ID NO: 1589789 - RNA, 19 nt, Homo sapiens
ccacucagauuggaauaga

SEQ ID NO: 1589790 - RNA, 19 nt, Homo sapiens
uaagcagucucaagauuca

SEQ ID NO: 1589791 - RNA, 19 nt, Homo sapiens
ggagagcauuugagcuuca

SEQ ID NO: 1589792 - RNA, 19 nt, Homo sapiens
gcauuugagcuucagauuu

SEQ ID NO: 1589793 - RNA, 19 nt, Homo sapiens
gcaacaaaauagaccagua

SEQ ID NO: 1589794 - RNA, 19 nt, Homo sapiens
acuaagcagucucaagauu

SEQ ID NO: 1589795 - RNA, 19 nt, Homo sapiens
ucaguaaccaucacaguug

SEQ ID NO: 1589796 - RNA, 19 nt, Homo sapiens
aaaaccaacuugucaugua

SEQ ID NO: 1589797 - RNA, 19 nt, Homo sapiens
ggccagaaaugcacuaagc

SEQ ID NO: 1589798 - RNA, 19 nt, Homo sapiens
guugcuacauggguguuua

SEQ ID NO: 1589799 - RNA, 19 nt, Homo sapiens
ucucaagauucaaagcauu

SEQ ID NO: 1589800 - RNA, 19 nt, Homo sapiens
caccagauuuucaugauaa

SEQ ID NO: 1589801 - RNA, 19 nt, Homo sapiens
ucuaacagccucuuugcaa

SEQ ID NO: 1589802 - RNA, 19 nt, Homo sapiens
gagcuucagauuucuaaca

SEQ ID NO: 1589803 - RNA, 19 nt, Homo sapiens
gaaacaucaguaaccauca

SEQ ID NO: 1589804 - RNA, 19 nt, Homo sapiens
auucaaagcauucugcaaa

SEQ ID NO: 1589805 - RNA, 19 nt, Homo sapiens
cugcaauccuucaugaugu

SEQ ID NO: 1589806 - RNA, 19 nt, Homo sapiens
aaauagaccaguagcugaa

SEQ ID NO: 1589807 - RNA, 19 nt, Homo sapiens
uggaacugcuuucuguguu

SEQ ID NO: 1589808 - RNA, 19 nt, Homo sapiens
gcaacugcaauccuucaug

SEQ ID NO: 1589809 - RNA, 19 nt, Homo sapiens
guuuacagccacucagauu

SEQ ID NO: 1589810 - RNA, 19 nt, Homo sapiens
uaacagccucuuugcaaca

SEQ ID NO: 1589811 - RNA, 19 nt, Homo sapiens
gaucaucuuuucuuugaca

SEQ ID NO: 1589812 - RNA, 19 nt, Homo sapiens
caaagcauucugcaaagca

SEQ ID NO: 1589813 - RNA, 19 nt, Homo sapiens
caaaagaguggaaacauca

SEQ ID NO: 1589814 - RNA, 19 nt, Homo sapiens
ccaaaagaguggaaacauc

SEQ ID NO: 1589815 - RNA, 19 nt, Homo sapiens
gacauuggaagcagaaucu

SEQ ID NO: 1589816 - RNA, 19 nt, Homo sapiens
cuaagcagucucaagauuc

SEQ ID NO: 1589817 - RNA, 19 nt, Homo sapiens
gcaauccuucaugauguuu

SEQ ID NO: 1589818 - RNA, 19 nt, Homo sapiens
agaguggaaacaucaguaa

SEQ ID NO: 1589819 - RNA, 19 nt, Homo sapiens
guggaaacaucaguaacca

SEQ ID NO: 1589820 - RNA, 19 nt, Homo sapiens
uggaauagaauggaaccua

SEQ ID NO: 1589821 - RNA, 19 nt, Homo sapiens
ucaccagauuuucaugaua

SEQ ID NO: 1589822 - RNA, 19 nt, Homo sapiens
gcaaagcauggcaagacau

SEQ ID NO: 1589823 - RNA, 19 nt, Homo sapiens
agauuggaauagaauggaa

SEQ ID NO: 1589824 - RNA, 19 nt, Homo sapiens
ugcaauccuucaugauguu

SEQ ID NO: 1589825 - RNA, 19 nt, Homo sapiens
gcugaaggcaacugcaauc

SEQ ID NO: 1589826 - RNA, 19 nt, Homo sapiens
aaacaucaguaaccaucac

SEQ ID NO: 1589827 - RNA, 19 nt, Homo sapiens
gagcauuugagcuucagau

SEQ ID NO: 1589828 - RNA, 19 nt, Homo sapiens
aagaguggaaacaucagua

SEQ ID NO: 1589829 - RNA, 19 nt, Homo sapiens
ugcaaagcauggcaagaca

SEQ ID NO: 1589830 - RNA, 19 nt, Homo sapiens
aaagcauucugcaaagcau

SEQ ID NO: 1589831 - RNA, 19 nt, Homo sapiens
guggaacugcuuucugugu

SEQ ID NO: 1589832 - RNA, 19 nt, Homo sapiens
ucaaagcauucugcaaagc

SEQ ID NO: 1589833 - RNA, 19 nt, Homo sapiens
agaauucucuuccaacaug

SEQ ID NO: 1589834 - RNA, 19 nt, Homo sapiens
gggcagagcuuagaacacu

SEQ ID NO: 1589835 - RNA, 19 nt, Homo sapiens
gcacugccucugcuuaaga

SEQ ID NO: 1589836 - RNA, 19 nt, Homo sapiens
gcacgcagaggaacaguca

SEQ ID NO: 1589837 - RNA, 19 nt, Homo sapiens
gagugaagcacaagaagga

SEQ ID NO: 1589838 - RNA, 19 nt, Homo sapiens
ggaagggcacgcagaggaa

SEQ ID NO: 1589839 - RNA, 19 nt, Homo sapiens
uuucagaaccgccgaguga

SEQ ID NO: 1589840 - RNA, 19 nt, Homo sapiens
ucgacucgcucaucaucaa

SEQ ID NO: 1589841 - RNA, 19 nt, Homo sapiens
gaauucucuuccaacaugu

SEQ ID NO: 1589842 - RNA, 19 nt, Homo sapiens
gcaccgccaccaccuacaa

SEQ ID NO: 1589843 - RNA, 19 nt, Homo sapiens
cgacuccggaggauugaaa

SEQ ID NO: 1589844 - RNA, 19 nt, Homo sapiens
uaugucgacucgcucauca

SEQ ID NO: 1589845 - RNA, 19 nt, Homo sapiens
gcagagcuuagaacacuag

SEQ ID NO: 1589846 - RNA, 19 nt, Homo sapiens
ggagcuggagagagaauuc

SEQ ID NO: 1589847 - RNA, 19 nt, Homo sapiens
ggcagagcuuagaacacua

SEQ ID NO: 1589848 - RNA, 19 nt, Homo sapiens
uccuggagcuggagagaga

SEQ ID NO: 1589849 - RNA, 19 nt, Homo sapiens
caacgaugacaaggagauu

SEQ ID NO: 1589850 - RNA, 19 nt, Homo sapiens
ccagccagguacccaaugg

SEQ ID NO: 1589851 - RNA, 19 nt, Homo sapiens
ucucgacuccggaggauug

SEQ ID NO: 1589852 - RNA, 19 nt, Homo sapiens
cccaauggcaagaggauga

SEQ ID NO: 1589853 - RNA, 19 nt, Homo sapiens
ugaggacggcguucacuag

SEQ ID NO: 1589854 - RNA, 19 nt, Homo sapiens
gggugaaccaugcgcauca

SEQ ID NO: 1589855 - RNA, 19 nt, Homo sapiens
guucaaaccucaacuauua

SEQ ID NO: 1589856 - RNA, 19 nt, Homo sapiens
ggugauaacuguccuaaua

SEQ ID NO: 1589857 - RNA, 19 nt, Homo sapiens
gaaguauccuggaaacaua

SEQ ID NO: 1589858 - RNA, 19 nt, Homo sapiens
ugacuaauaugccauguua

SEQ ID NO: 1589859 - RNA, 19 nt, Homo sapiens
caagaauacuuccaacaua

SEQ ID NO: 1589860 - RNA, 19 nt, Homo sapiens
agaagaagcuuggaacuua

SEQ ID NO: 1589861 - RNA, 19 nt, Homo sapiens
gacgagagcuuguguuguu

SEQ ID NO: 1589862 - RNA, 19 nt, Homo sapiens
ggauuuaucucuuuacugu

SEQ ID NO: 1589863 - RNA, 19 nt, Homo sapiens
gugauuaucucuaugacua

SEQ ID NO: 1589864 - RNA, 19 nt, Homo sapiens
cauggaagcuugaguaugu

SEQ ID NO: 1589865 - RNA, 19 nt, Homo sapiens
gcauacuucucaauucuuu

SEQ ID NO: 1589866 - RNA, 19 nt, Homo sapiens
gaagaagcuuggaacuuau

SEQ ID NO: 1589867 - RNA, 19 nt, Homo sapiens
uaaaagcgauggauacaua

SEQ ID NO: 1589868 - RNA, 19 nt, Homo sapiens
gaugauagcaccuccauau

SEQ ID NO: 1589869 - RNA, 19 nt, Homo sapiens
uaccagaaguguucauuaa

SEQ ID NO: 1589870 - RNA, 19 nt, Homo sapiens
gauacaagcaagaauagua

SEQ ID NO: 1589871 - RNA, 19 nt, Homo sapiens
ugauagcaccuccauauua

SEQ ID NO: 1589872 - RNA, 19 nt, Homo sapiens
ugaaauaaauggcauggau

SEQ ID NO: 1589873 - RNA, 19 nt, Homo sapiens
gaauugagacugcaaagga

SEQ ID NO: 1589874 - RNA, 19 nt, Homo sapiens
gauagcaccuccauauuac

SEQ ID NO: 1589875 - RNA, 19 nt, Homo sapiens
ggaagaauaaugacuccua

SEQ ID NO: 1589876 - RNA, 19 nt, Homo sapiens
gaaauaaauggcauggauu

SEQ ID NO: 1589877 - RNA, 19 nt, Homo sapiens
ggagagaauauaauuguga

SEQ ID NO: 1589878 - RNA, 19 nt, Homo sapiens
cacuagagguuuaauaaga

SEQ ID NO: 1589879 - RNA, 19 nt, Homo sapiens
ugaugcugcuucauauuua

SEQ ID NO: 1589880 - RNA, 19 nt, Homo sapiens
uggaggaccuggauauauu

SEQ ID NO: 1589881 - RNA, 19 nt, Homo sapiens
gcaucuuacuggauaauau

SEQ ID NO: 1589882 - RNA, 19 nt, Homo sapiens
caaacaaugugcagaugau

SEQ ID NO: 1589883 - RNA, 19 nt, Homo sapiens
gaauuguucuauuggcauu

SEQ ID NO: 1589884 - RNA, 19 nt, Homo sapiens
ccagaaguguucauuaaag

SEQ ID NO: 1589885 - RNA, 19 nt, Homo sapiens
acacaucucuggguucuga

SEQ ID NO: 1589886 - RNA, 19 nt, Homo sapiens
gagcuuguguuguuuagca

SEQ ID NO: 1589887 - RNA, 19 nt, Homo sapiens
guuuagaucugcuagguau

SEQ ID NO: 1589888 - RNA, 19 nt, Homo sapiens
uaauggagcuagauacaag

SEQ ID NO: 1589889 - RNA, 19 nt, Homo sapiens
gcuuggaacuuauaguguu

SEQ ID NO: 1589890 - RNA, 19 nt, Homo sapiens
aauugaagcuaucugcaua

SEQ ID NO: 1589891 - RNA, 19 nt, Homo sapiens
gcaaacaaugugcagauga

SEQ ID NO: 1589892 - RNA, 19 nt, Homo sapiens
caaaucaauucuugcauac

SEQ ID NO: 1589893 - RNA, 19 nt, Homo sapiens
uaucaugagcucaaguuua

SEQ ID NO: 1589894 - RNA, 19 nt, Homo sapiens
cuagauacaagcaagaaua

SEQ ID NO: 1589895 - RNA, 19 nt, Homo sapiens
cacagugccuggaagaauu

SEQ ID NO: 1589896 - RNA, 19 nt, Homo sapiens
gaaguguucauuaaaggaa

SEQ ID NO: 1589897 - RNA, 19 nt, Homo sapiens
caccaaaacucuucuugua

SEQ ID NO: 1589898 - RNA, 19 nt, Homo sapiens
guuccuaggugauaacugu

SEQ ID NO: 1589899 - RNA, 19 nt, Homo sapiens
uuuagcaucuuacuggaua

SEQ ID NO: 1589900 - RNA, 19 nt, Homo sapiens
acaguuggcuauggagaua

SEQ ID NO: 1589901 - RNA, 19 nt, Homo sapiens
uuacuugucuucauuugug

SEQ ID NO: 1589902 - RNA, 19 nt, Homo sapiens
ggauuaaagcuuugugguu

SEQ ID NO: 1589903 - RNA, 19 nt, Homo sapiens
ugaauguuguacacaguaa

SEQ ID NO: 1589904 - RNA, 19 nt, Homo sapiens
ccauaaagaaguuagugua

SEQ ID NO: 1589905 - RNA, 19 nt, Homo sapiens
gagcucaaguuuagaucug

SEQ ID NO: 1589906 - RNA, 19 nt, Homo sapiens
aaacguugcuaccgagaga

SEQ ID NO: 1589907 - RNA, 19 nt, Homo sapiens
ggaggaccuggauauauuu

SEQ ID NO: 1589908 - RNA, 19 nt, Homo sapiens
ucaguggaauuguucuauu

SEQ ID NO: 1589909 - RNA, 19 nt, Homo sapiens
ggaauaauuugagaugacu

SEQ ID NO: 1589910 - RNA, 19 nt, Homo sapiens
caaacaagaauacuuccaa

SEQ ID NO: 1589911 - RNA, 19 nt, Homo sapiens
cagcauacuucucaauucu

SEQ ID NO: 1589912 - RNA, 19 nt, Homo sapiens
gcauacacuucauagaaag

SEQ ID NO: 1589913 - RNA, 19 nt, Homo sapiens
ugcauacacuucauagaaa

SEQ ID NO: 1589914 - RNA, 19 nt, Homo sapiens
caguggaauuguucuauug

SEQ ID NO: 1589915 - RNA, 19 nt, Homo sapiens
ggugggugauuaucucuau

SEQ ID NO: 1589916 - RNA, 19 nt, Homo sapiens
gagguucauugucuccaaa

SEQ ID NO: 1589917 - RNA, 19 nt, Homo sapiens
gaggguacuuagaaugaug

SEQ ID NO: 1589918 - RNA, 19 nt, Homo sapiens
cguauuacaucucuguguu

SEQ ID NO: 1589919 - RNA, 19 nt, Homo sapiens
gcagguuaaucuucacaca

SEQ ID NO: 1589920 - RNA, 19 nt, Homo sapiens
aauaaaggguuaccagaag

SEQ ID NO: 1589921 - RNA, 19 nt, Homo sapiens
ccagcauacuucucaauuc

SEQ ID NO: 1589922 - RNA, 19 nt, Homo sapiens
ggaguaaauagaauugaga

SEQ ID NO: 1589923 - RNA, 19 nt, Homo sapiens
ucacacuucuuugucauug

SEQ ID NO: 1589924 - RNA, 19 nt, Homo sapiens
gauggaggaccuggauaua

SEQ ID NO: 1589925 - RNA, 19 nt, Homo sapiens
gcaguggcauugucaucau

SEQ ID NO: 1589926 - RNA, 19 nt, Homo sapiens
gaugcugcuucauauuuau

SEQ ID NO: 1589927 - RNA, 19 nt, Homo sapiens
gcaggagagaauauaauug

SEQ ID NO: 1589928 - RNA, 19 nt, Homo sapiens
gagagaugguuauguuacu

SEQ ID NO: 1589929 - RNA, 19 nt, Homo sapiens
ggcaggagagaauauaauu

SEQ ID NO: 1589930 - RNA, 19 nt, Homo sapiens
aaauaaaggguuaccagaa

SEQ ID NO: 1589931 - RNA, 19 nt, Homo sapiens
gaggaccuggauauauuua

SEQ ID NO: 1589932 - RNA, 19 nt, Homo sapiens
agacagggauugggaagug

SEQ ID NO: 1589933 - RNA, 19 nt, Homo sapiens
ugugcgagcucuccuucua

SEQ ID NO: 1589934 - RNA, 19 nt, Homo sapiens
uugaguauguucucccuuu

SEQ ID NO: 1589935 - RNA, 19 nt, Homo sapiens
ucacaugcgggaacuguuu

SEQ ID NO: 1589936 - RNA, 19 nt, Homo sapiens
ugucagaaguauccuggaa

SEQ ID NO: 1589937 - RNA, 19 nt, Homo sapiens
gcaaucacgccguauuaca

SEQ ID NO: 1589938 - RNA, 19 nt, Homo sapiens
aaaucacacuucuuuguca

SEQ ID NO: 1589939 - RNA, 19 nt, Homo sapiens
caggagagaauauaauugu

SEQ ID NO: 1589940 - RNA, 19 nt, Homo sapiens
gugaaggagucagggcuaa

SEQ ID NO: 1589941 - RNA, 19 nt, Homo sapiens
ccguuuccuugaaugauua

SEQ ID NO: 1589942 - RNA, 19 nt, Homo sapiens
cgagagcuuguguuguuua

SEQ ID NO: 1589943 - RNA, 19 nt, Homo sapiens
uguaaugacucaaaaggua

SEQ ID NO: 1589944 - RNA, 19 nt, Homo sapiens
gcgcaacgaguacuucuuc

SEQ ID NO: 1589945 - RNA, 19 nt, Homo sapiens
caaggacuuuaccagcauu

SEQ ID NO: 1589946 - RNA, 19 nt, Homo sapiens
caaccucuucuucucuuaa

SEQ ID NO: 1589947 - RNA, 19 nt, Homo sapiens
ggaggaguuuguguuguca

SEQ ID NO: 1589948 - RNA, 19 nt, Homo sapiens
cagaaguguucauuaaagg

SEQ ID NO: 1589949 - RNA, 19 nt, Homo sapiens
gagagcuuguguuguuuag

SEQ ID NO: 1589950 - RNA, 19 nt, Homo sapiens
gggagcugcugaaggacuu

SEQ ID NO: 1589951 - RNA, 19 nt, Homo sapiens
ucauaucaaugucagaagu

SEQ ID NO: 1589952 - RNA, 19 nt, Homo sapiens
agacugcaaaggaagaaua

SEQ ID NO: 1589953 - RNA, 19 nt, Homo sapiens
uggcauuaccuaucacuuu

SEQ ID NO: 1589954 - RNA, 19 nt, Homo sapiens
cuauuggcauuaccuauca

SEQ ID NO: 1589955 - RNA, 19 nt, Homo sapiens
guucaaaccucaacuauua

SEQ ID NO: 1589956 - RNA, 19 nt, Homo sapiens
ggugauaacuguccuaaua

SEQ ID NO: 1589957 - RNA, 19 nt, Homo sapiens
gaaguauccuggaaacaua

SEQ ID NO: 1589958 - RNA, 19 nt, Homo sapiens
ugacuaauaugccauguua

SEQ ID NO: 1589959 - RNA, 19 nt, Homo sapiens
caagaauacuuccaacaua

SEQ ID NO: 1589960 - RNA, 19 nt, Homo sapiens
agaagaagcuuggaacuua

SEQ ID NO: 1589961 - RNA, 19 nt, Homo sapiens
gacgagagcuuguguuguu

SEQ ID NO: 1589962 - RNA, 19 nt, Homo sapiens
ggauuuaucucuuuacugu

SEQ ID NO: 1589963 - RNA, 19 nt, Homo sapiens
gugauuaucucuaugacua

SEQ ID NO: 1589964 - RNA, 19 nt, Homo sapiens
cauggaagcuugaguaugu

SEQ ID NO: 1589965 - RNA, 19 nt, Homo sapiens
gcauacuucucaauucuuu

SEQ ID NO: 1589966 - RNA, 19 nt, Homo sapiens
gaagaagcuuggaacuuau

SEQ ID NO: 1589967 - RNA, 19 nt, Homo sapiens
uaaaagcgauggauacaua

SEQ ID NO: 1589968 - RNA, 19 nt, Homo sapiens
gaugauagcaccuccauau

SEQ ID NO: 1589969 - RNA, 19 nt, Homo sapiens
uaccagaaguguucauuaa

SEQ ID NO: 1589970 - RNA, 19 nt, Homo sapiens
gauacaagcaagaauagua

SEQ ID NO: 1589971 - RNA, 19 nt, Homo sapiens
ugauagcaccuccauauua

SEQ ID NO: 1589972 - RNA, 19 nt, Homo sapiens
ugaaauaaauggcauggau

SEQ ID NO: 1589973 - RNA, 19 nt, Homo sapiens
gaauugagacugcaaagga

SEQ ID NO: 1589974 - RNA, 19 nt, Homo sapiens
gauagcaccuccauauuac

SEQ ID NO: 1589975 - RNA, 19 nt, Homo sapiens
ggaagaauaaugacuccua

SEQ ID NO: 1589976 - RNA, 19 nt, Homo sapiens
gaccggagcaggauaauug

SEQ ID NO: 1589977 - RNA, 19 nt, Homo sapiens
gaaauaaauggcauggauu

SEQ ID NO: 1589978 - RNA, 19 nt, Homo sapiens
ggagagaauauaauuguga

SEQ ID NO: 1589979 - RNA, 19 nt, Homo sapiens
cacuagagguuuaauaaga

SEQ ID NO: 1589980 - RNA, 19 nt, Homo sapiens
ugaugcugcuucauauuua

SEQ ID NO: 1589981 - RNA, 19 nt, Homo sapiens
uggaggaccuggauauauu

SEQ ID NO: 1589982 - RNA, 19 nt, Homo sapiens
gcaucuuacuggauaauau

SEQ ID NO: 1589983 - RNA, 19 nt, Homo sapiens
caaacaaugugcagaugau

SEQ ID NO: 1589984 - RNA, 19 nt, Homo sapiens
gaauuguucuauuggcauu

SEQ ID NO: 1589985 - RNA, 19 nt, Homo sapiens
ccagaaguguucauuaaag

SEQ ID NO: 1589986 - RNA, 19 nt, Homo sapiens
acacaucucuggguucuga

SEQ ID NO: 1589987 - RNA, 19 nt, Homo sapiens
gagcuuguguuguuuagca

SEQ ID NO: 1589988 - RNA, 19 nt, Homo sapiens
guuuagaucugcuagguau

SEQ ID NO: 1589989 - RNA, 19 nt, Homo sapiens
uaauggagcuagauacaag

SEQ ID NO: 1589990 - RNA, 19 nt, Homo sapiens
gcuuggaacuuauaguguu

SEQ ID NO: 1589991 - RNA, 19 nt, Homo sapiens
aauugaagcuaucugcaua

SEQ ID NO: 1589992 - RNA, 19 nt, Homo sapiens
gcaaacaaugugcagauga

SEQ ID NO: 1589993 - RNA, 19 nt, Homo sapiens
caaaucaauucuugcauac

SEQ ID NO: 1589994 - RNA, 19 nt, Homo sapiens
uaucaugagcucaaguuua

SEQ ID NO: 1589995 - RNA, 19 nt, Homo sapiens
gcaggauaauugaagcuau

SEQ ID NO: 1589996 - RNA, 19 nt, Homo sapiens
cuagauacaagcaagaaua

SEQ ID NO: 1589997 - RNA, 19 nt, Homo sapiens
cacagugccuggaagaauu

SEQ ID NO: 1589998 - RNA, 19 nt, Homo sapiens
gaaguguucauuaaaggaa

SEQ ID NO: 1589999 - RNA, 19 nt, Homo sapiens
caccaaaacucuucuugua

SEQ ID NO: 1590000 - RNA, 19 nt, Homo sapiens
guuccuaggugauaacugu

SEQ ID NO: 1590001 - RNA, 19 nt, Homo sapiens
uuuagcaucuuacuggaua

SEQ ID NO: 1590002 - RNA, 19 nt, Homo sapiens
acaguuggcuauggagaua

SEQ ID NO: 1590003 - RNA, 19 nt, Homo sapiens
uuacuugucuucauuugug

SEQ ID NO: 1590004 - RNA, 19 nt, Homo sapiens
ggauuaaagcuuugugguu

SEQ ID NO: 1590005 - RNA, 19 nt, Homo sapiens
ugaauguuguacacaguaa

SEQ ID NO: 1590006 - RNA, 19 nt, Homo sapiens
ccauaaagaaguuagugua

SEQ ID NO: 1590007 - RNA, 19 nt, Homo sapiens
gagcucaaguuuagaucug

SEQ ID NO: 1590008 - RNA, 19 nt, Homo sapiens
aaacguugcuaccgagaga

SEQ ID NO: 1590009 - RNA, 19 nt, Homo sapiens
ggaggaccuggauauauuu

SEQ ID NO: 1590010 - RNA, 19 nt, Homo sapiens
ucaguggaauuguucuauu

SEQ ID NO: 1590011 - RNA, 19 nt, Homo sapiens
ggaauaauuugagaugacu

SEQ ID NO: 1590012 - RNA, 19 nt, Homo sapiens
caaacaagaauacuuccaa

SEQ ID NO: 1590013 - RNA, 19 nt, Homo sapiens
cagcauacuucucaauucu

SEQ ID NO: 1590014 - RNA, 19 nt, Homo sapiens
gcauacacuucauagaaag

SEQ ID NO: 1590015 - RNA, 19 nt, Homo sapiens
ugcauacacuucauagaaa

SEQ ID NO: 1590016 - RNA, 19 nt, Homo sapiens
caguggaauuguucuauug

SEQ ID NO: 1590017 - RNA, 19 nt, Homo sapiens
ggugggugauuaucucuau

SEQ ID NO: 1590018 - RNA, 19 nt, Homo sapiens
gagguucauugucuccaaa

SEQ ID NO: 1590019 - RNA, 19 nt, Homo sapiens
gaggguacuuagaaugaug

SEQ ID NO: 1590020 - RNA, 19 nt, Homo sapiens
cguauuacaucucuguguu

SEQ ID NO: 1590021 - RNA, 19 nt, Homo sapiens
gcagguuaaucuucacaca

SEQ ID NO: 1590022 - RNA, 19 nt, Homo sapiens
aauaaaggguuaccagaag

SEQ ID NO: 1590023 - RNA, 19 nt, Homo sapiens
ccagcauacuucucaauuc

SEQ ID NO: 1590024 - RNA, 19 nt, Homo sapiens
ggaguaaauagaauugaga

SEQ ID NO: 1590025 - RNA, 19 nt, Homo sapiens
ucacacuucuuugucauug

SEQ ID NO: 1590026 - RNA, 19 nt, Homo sapiens
gauggaggaccuggauaua

SEQ ID NO: 1590027 - RNA, 19 nt, Homo sapiens
gcaguggcauugucaucau

SEQ ID NO: 1590028 - RNA, 19 nt, Homo sapiens
gaugcugcuucauauuuau

SEQ ID NO: 1590029 - RNA, 19 nt, Homo sapiens
gcaggagagaauauaauug

SEQ ID NO: 1590030 - RNA, 19 nt, Homo sapiens
gagagaugguuauguuacu

SEQ ID NO: 1590031 - RNA, 19 nt, Homo sapiens
ugugcgagcucuccuucua

SEQ ID NO: 1590032 - RNA, 19 nt, Homo sapiens
ggcaggagagaauauaauu

SEQ ID NO: 1590033 - RNA, 19 nt, Homo sapiens
aaauaaaggguuaccagaa

SEQ ID NO: 1590034 - RNA, 19 nt, Homo sapiens
gaggaccuggauauauuua

SEQ ID NO: 1590035 - RNA, 19 nt, Homo sapiens
agacagggauugggaagug

SEQ ID NO: 1590036 - RNA, 19 nt, Homo sapiens
uugaguauguucucccuuu

SEQ ID NO: 1590037 - RNA, 19 nt, Homo sapiens
ucacaugcgggaacuguuu

SEQ ID NO: 1590038 - RNA, 19 nt, Homo sapiens
ugucagaaguauccuggaa

SEQ ID NO: 1590039 - RNA, 19 nt, Homo sapiens
gaugaccggagcaggauaa

SEQ ID NO: 1590040 - RNA, 19 nt, Homo sapiens
gcaaucacgccguauuaca

SEQ ID NO: 1590041 - RNA, 19 nt, Homo sapiens
aaaucacacuucuuuguca

SEQ ID NO: 1590042 - RNA, 19 nt, Homo sapiens
caggagagaauauaauugu

SEQ ID NO: 1590043 - RNA, 19 nt, Homo sapiens
gugaaggagucagggcuaa

SEQ ID NO: 1590044 - RNA, 19 nt, Homo sapiens
ccguuuccuugaaugauua

SEQ ID NO: 1590045 - RNA, 19 nt, Homo sapiens
cgagagcuuguguuguuua

SEQ ID NO: 1590046 - RNA, 19 nt, Homo sapiens
uguaaugacucaaaaggua

SEQ ID NO: 1590047 - RNA, 19 nt, Homo sapiens
gcgcaacgaguacuucuuc

SEQ ID NO: 1590048 - RNA, 19 nt, Homo sapiens
caaggacuuuaccagcauu

SEQ ID NO: 1590049 - RNA, 19 nt, Homo sapiens
caaccucuucuucucuuaa

SEQ ID NO: 1590050 - RNA, 19 nt, Homo sapiens
ggaggaguuuguguuguca

SEQ ID NO: 1590051 - RNA, 19 nt, Homo sapiens
cagaaguguucauuaaagg

SEQ ID NO: 1590052 - RNA, 19 nt, Homo sapiens
gagagcuuguguuguuuag

SEQ ID NO: 1590053 - RNA, 19 nt, Homo sapiens
gggagcugcugaaggacuu

SEQ ID NO: 1590054 - RNA, 19 nt, Homo sapiens
ucauaucaaugucagaagu

SEQ ID NO: 1590055 - RNA, 19 nt, Homo sapiens
gcacaaagaugaaccaugu

SEQ ID NO: 1590056 - RNA, 19 nt, Homo sapiens
caaauuaccucaagaauac

SEQ ID NO: 1590057 - RNA, 19 nt, Homo sapiens
gacaauggcuugaaucuug

SEQ ID NO: 1590058 - RNA, 19 nt, Homo sapiens
caaacaagguggaugauga

SEQ ID NO: 1590059 - RNA, 19 nt, Homo sapiens
ggcaaacagucuauuaaua

SEQ ID NO: 1590060 - RNA, 19 nt, Homo sapiens
ggaaugcagucccguguaa

SEQ ID NO: 1590061 - RNA, 19 nt, Homo sapiens
gaagaucucugccaaaggu

SEQ ID NO: 1590062 - RNA, 19 nt, Homo sapiens
gccaggagauucauucuaa

SEQ ID NO: 1590063 - RNA, 19 nt, Homo sapiens
gaacaaugccagauccuuu

SEQ ID NO: 1590064 - RNA, 19 nt, Homo sapiens
gcaagaagaaucaaaguug

SEQ ID NO: 1590065 - RNA, 19 nt, Homo sapiens
caaggaagauuuggaaaga

SEQ ID NO: 1590066 - RNA, 19 nt, Homo sapiens
gagcaaccaugucaaacaa

SEQ ID NO: 1590067 - RNA, 19 nt, Homo sapiens
gaauuauggucuucacuau

SEQ ID NO: 1590068 - RNA, 19 nt, Homo sapiens
ugaaaugggucacaacaug

SEQ ID NO: 1590069 - RNA, 19 nt, Homo sapiens
gguagaaggugagaaagaa

SEQ ID NO: 1590070 - RNA, 19 nt, Homo sapiens
caagguggaugaugacaga

SEQ ID NO: 1590071 - RNA, 19 nt, Homo sapiens
cgaaugggaucguuucaga

SEQ ID NO: 1590072 - RNA, 19 nt, Homo sapiens
gaagaucauugugguguau

SEQ ID NO: 1590073 - RNA, 19 nt, Homo sapiens
gacauacacugcugaugaa

SEQ ID NO: 1590074 - RNA, 19 nt, Homo sapiens
gcaaugguuuccuaucaug

SEQ ID NO: 1590075 - RNA, 19 nt, Homo sapiens
uggcugugaugguuuauua

SEQ ID NO: 1590076 - RNA, 19 nt, Homo sapiens
caagaagaaucaaaguugu

SEQ ID NO: 1590077 - RNA, 19 nt, Homo sapiens
ggagaucaguggccagugu

SEQ ID NO: 1590078 - RNA, 19 nt, Homo sapiens
gcaaugagcaaccauguca

SEQ ID NO: 1590079 - RNA, 19 nt, Homo sapiens
gaaaggaagacaacagugu

SEQ ID NO: 1590080 - RNA, 19 nt, Homo sapiens
aaacaaauccgcagagugu

SEQ ID NO: 1590081 - RNA, 19 nt, Homo sapiens
uuagauaucugugcaaaug

SEQ ID NO: 1590082 - RNA, 19 nt, Homo sapiens
uacaauugcucaugaaaug

SEQ ID NO: 1590083 - RNA, 19 nt, Homo sapiens
ccaugaaacuccaccagaa

SEQ ID NO: 1590084 - RNA, 19 nt, Homo sapiens
ggucaaucuucgugugaua

SEQ ID NO: 1590085 - RNA, 19 nt, Homo sapiens
cauagagacuguagugguu

SEQ ID NO: 1590086 - RNA, 19 nt, Homo sapiens
gagggaaacgauauucaua

SEQ ID NO: 1590087 - RNA, 19 nt, Homo sapiens
gaacagccuauucuucuau

SEQ ID NO: 1590088 - RNA, 19 nt, Homo sapiens
ugacauacacugcugauga

SEQ ID NO: 1590089 - RNA, 19 nt, Homo sapiens
guggcaacaugaagaauuu

SEQ ID NO: 1590090 - RNA, 19 nt, Homo sapiens
cagcaaugguuuccuauca

SEQ ID NO: 1590091 - RNA, 19 nt, Homo sapiens
cagaggagcagguuaugua

SEQ ID NO: 1590092 - RNA, 19 nt, Homo sapiens
uaucaugucuggugaaugg

SEQ ID NO: 1590093 - RNA, 19 nt, Homo sapiens
aaagaugaaccaugugaua

SEQ ID NO: 1590094 - RNA, 19 nt, Homo sapiens
gagguggccugaugggauu

SEQ ID NO: 1590095 - RNA, 19 nt, Homo sapiens
aauagugacuggaagauug

SEQ ID NO: 1590096 - RNA, 19 nt, Homo sapiens
gauuagauaucugugcaaa

SEQ ID NO: 1590097 - RNA, 19 nt, Homo sapiens
gagaaagaaugcagaacca

SEQ ID NO: 1590098 - RNA, 19 nt, Homo sapiens
caagguagaaggugagaaa

SEQ ID NO: 1590099 - RNA, 19 nt, Homo sapiens
caacauagagacuguagug

SEQ ID NO: 1590100 - RNA, 19 nt, Homo sapiens
gggaaacgauauucauaca

SEQ ID NO: 1590101 - RNA, 19 nt, Homo sapiens
gcagacaaguggccuguac

SEQ ID NO: 1590102 - RNA, 19 nt, Homo sapiens
ugaauacacuaucccauca

SEQ ID NO: 1590103 - RNA, 19 nt, Homo sapiens
guguaaggcuggagaaugu

SEQ ID NO: 1590104 - RNA, 19 nt, Homo sapiens
agacaugacuucaguggau

SEQ ID NO: 1590105 - RNA, 19 nt, Homo sapiens
ggagugggaagucguguuu

SEQ ID NO: 1590106 - RNA, 19 nt, Homo sapiens
ggucacaacaugggcauua

SEQ ID NO: 1590107 - RNA, 19 nt, Homo sapiens
ggcaagcuguccuggauga

SEQ ID NO: 1590108 - RNA, 19 nt, Homo sapiens
gaucagaauuauggucuuc

SEQ ID NO: 1590109 - RNA, 19 nt, Homo sapiens
aaaguuggcugugaugguu

SEQ ID NO: 1590110 - RNA, 19 nt, Homo sapiens
gaagcaagggauuguaaug

SEQ ID NO: 1590111 - RNA, 19 nt, Homo sapiens
aaagauuucucaggucaaa

SEQ ID NO: 1590112 - RNA, 19 nt, Homo sapiens
ugaagacaauggcuugaau

SEQ ID NO: 1590113 - RNA, 19 nt, Homo sapiens
caccagaacuauauauugg

SEQ ID NO: 1590114 - RNA, 19 nt, Homo sapiens
gcugaagacugugaggauu

SEQ ID NO: 1590115 - RNA, 19 nt, Homo sapiens
ugucaggcuuauaguguua

SEQ ID NO: 1590116 - RNA, 19 nt, Homo sapiens
ggaagagggaaacgauauu

SEQ ID NO: 1590117 - RNA, 19 nt, Homo sapiens
aggaagacauggaaaugaa

SEQ ID NO: 1590118 - RNA, 19 nt, Homo sapiens
ucaauuaccuguggcaaag

SEQ ID NO: 1590119 - RNA, 19 nt, Homo sapiens
uggucuaagugcucaauua

SEQ ID NO: 1590120 - RNA, 19 nt, Homo sapiens
cagggaggcugaagacugu

SEQ ID NO: 1590121 - RNA, 19 nt, Homo sapiens
gcuggcaaacagucuauua

SEQ ID NO: 1590122 - RNA, 19 nt, Homo sapiens
ccagaaaguuggcugugau

SEQ ID NO: 1590123 - RNA, 19 nt, Homo sapiens
aggaagauuuggaaagauu

SEQ ID NO: 1590124 - RNA, 19 nt, Homo sapiens
gaaucuuggugacguuuca

SEQ ID NO: 1590125 - RNA, 19 nt, Homo sapiens
gaagacauggaaaugaaug

SEQ ID NO: 1590126 - RNA, 19 nt, Homo sapiens
caacaacugagcaauggaa

SEQ ID NO: 1590127 - RNA, 19 nt, Homo sapiens
cacacaagcugggaagauu

SEQ ID NO: 1590128 - RNA, 19 nt, Homo sapiens
auuauggucuucacuauga

SEQ ID NO: 1590129 - RNA, 19 nt, Homo sapiens
gccggcacauagcuauuua

SEQ ID NO: 1590130 - RNA, 19 nt, Homo sapiens
gcaaauguccugggcuaga

SEQ ID NO: 1590131 - RNA, 19 nt, Homo sapiens
ggagauucauucuaaccau

SEQ ID NO: 1590132 - RNA, 19 nt, Homo sapiens
cuucaacccugcaaugaga

SEQ ID NO: 1590133 - RNA, 19 nt, Homo sapiens
guccugggcuagauucuga

SEQ ID NO: 1590134 - RNA, 19 nt, Homo sapiens
ugguauagcuuacuugagu

SEQ ID NO: 1590135 - RNA, 19 nt, Homo sapiens
ggacaaugagaaaugcaaa

SEQ ID NO: 1590136 - RNA, 19 nt, Homo sapiens
gagugucaauucugugaug

SEQ ID NO: 1590137 - RNA, 19 nt, Homo sapiens
gcaaggaagauuuggaaag

SEQ ID NO: 1590138 - RNA, 19 nt, Homo sapiens
guaaguggcaacaugaaga

SEQ ID NO: 1590139 - RNA, 19 nt, Homo sapiens
ccaccagaacuauauauug

SEQ ID NO: 1590140 - RNA, 19 nt, Homo sapiens
ucauuacugugguaucauu

SEQ ID NO: 1590141 - RNA, 19 nt, Homo sapiens
caauacagaauaugugaga

SEQ ID NO: 1590142 - RNA, 19 nt, Homo sapiens
caaauguccugggcuagau

SEQ ID NO: 1590143 - RNA, 19 nt, Homo sapiens
ggaagauuuggaaagauuu

SEQ ID NO: 1590144 - RNA, 19 nt, Homo sapiens
gaagagggaaacgauauuc

SEQ ID NO: 1590145 - RNA, 19 nt, Homo sapiens
gaggacuucauauuuauug

SEQ ID NO: 1590146 - RNA, 19 nt, Homo sapiens
gcagucccguguaauccaa

SEQ ID NO: 1590147 - RNA, 19 nt, Homo sapiens
aaucaaaguuguggaggaa

SEQ ID NO: 1590148 - RNA, 19 nt, Homo sapiens
aggagcagguuauguagaa

SEQ ID NO: 1590149 - RNA, 19 nt, Homo sapiens
auacacugcugaugaacaa

SEQ ID NO: 1590150 - RNA, 19 nt, Homo sapiens
aguaacugcuugcuacaaa

SEQ ID NO: 1590151 - RNA, 19 nt, Homo sapiens
gauguagcaaggaagauuu

SEQ ID NO: 1590152 - RNA, 19 nt, Homo sapiens
uuagagaugucaacaaacu

SEQ ID NO: 1590153 - RNA, 19 nt, Homo sapiens
ggauggcgacgaaguguug

SEQ ID NO: 1590154 - RNA, 19 nt, Homo sapiens
cacacacacuagcauguuu

SEQ ID NO: 1590155 - RNA, 19 nt, Homo sapiens
gaacgucucuuccuaauuu

SEQ ID NO: 1590156 - RNA, 19 nt, Homo sapiens
ggaaugauguggugauuua

SEQ ID NO: 1590157 - RNA, 19 nt, Homo sapiens
ggaggaggcugaaaucaaa

SEQ ID NO: 1590158 - RNA, 19 nt, Homo sapiens
gagcaguucucuuccuuua

SEQ ID NO: 1590159 - RNA, 19 nt, Homo sapiens
uaaaguaacuccuggcauu

SEQ ID NO: 1590160 - RNA, 19 nt, Homo sapiens
gcaaggcagucccaaguuu

SEQ ID NO: 1590161 - RNA, 19 nt, Homo sapiens
ccaaggcucucguuucuaa

SEQ ID NO: 1590162 - RNA, 19 nt, Homo sapiens
caacuuaagcgucuguuua

SEQ ID NO: 1590163 - RNA, 19 nt, Homo sapiens
gaaaggaacuggccaagcu

SEQ ID NO: 1590164 - RNA, 19 nt, Homo sapiens
gaggaaagcugccuacuac

SEQ ID NO: 1590165 - RNA, 19 nt, Homo sapiens
guaaauggauguauuguac

SEQ ID NO: 1590166 - RNA, 19 nt, Homo sapiens
ggauacagccucugacuuu

SEQ ID NO: 1590167 - RNA, 19 nt, Homo sapiens
ggagaaggaugaaggacaa

SEQ ID NO: 1590168 - RNA, 19 nt, Homo sapiens
gaucgucaguccuuucgua

SEQ ID NO: 1590169 - RNA, 19 nt, Homo sapiens
gaagcaaauuuggaacuuu

SEQ ID NO: 1590170 - RNA, 19 nt, Homo sapiens
uaaccuaccugaacuaagu

SEQ ID NO: 1590171 - RNA, 19 nt, Homo sapiens
ggagagggguuguuuuaua

SEQ ID NO: 1590172 - RNA, 19 nt, Homo sapiens
gaucuucgguggacaagga

SEQ ID NO: 1590173 - RNA, 19 nt, Homo sapiens
gaacagagcauuugaugac

SEQ ID NO: 1590174 - RNA, 19 nt, Homo sapiens
ggaaguccgugcuauguca

SEQ ID NO: 1590175 - RNA, 19 nt, Homo sapiens
ggauucaacuuucacguau

SEQ ID NO: 1590176 - RNA, 19 nt, Homo sapiens
gguguaaucuccuucucua

SEQ ID NO: 1590177 - RNA, 19 nt, Homo sapiens
gcaguucucuuccuuuagu

SEQ ID NO: 1590178 - RNA, 19 nt, Homo sapiens
ggaaagugauacuagacaa

SEQ ID NO: 1590179 - RNA, 19 nt, Homo sapiens
gaaggauccuguaaaugug

SEQ ID NO: 1590180 - RNA, 19 nt, Homo sapiens
agugggagaugauacauua

SEQ ID NO: 1590181 - RNA, 19 nt, Homo sapiens
gauuuagaaugcaguauug

SEQ ID NO: 1590182 - RNA, 19 nt, Homo sapiens
ugaaaugauugacuuguga

SEQ ID NO: 1590183 - RNA, 19 nt, Homo sapiens
cagagggacuugaaacuga

SEQ ID NO: 1590184 - RNA, 19 nt, Homo sapiens
gcugagaucccuccaguuu

SEQ ID NO: 1590185 - RNA, 19 nt, Homo sapiens
cgauguaucucuugaugaa

SEQ ID NO: 1590186 - RNA, 19 nt, Homo sapiens
gcagaaggacuaaaggaaa

SEQ ID NO: 1590187 - RNA, 19 nt, Homo sapiens
ccucaaagcucuguguauu

SEQ ID NO: 1590188 - RNA, 19 nt, Homo sapiens
ggucacaguugagucauuu

SEQ ID NO: 1590189 - RNA, 19 nt, Homo sapiens
ggaaagagcccaggagauc

SEQ ID NO: 1590190 - RNA, 19 nt, Homo sapiens
gacaggaaauggagaagga

SEQ ID NO: 1590191 - RNA, 19 nt, Homo sapiens
guuaagugcuucuggauuc

SEQ ID NO: 1590192 - RNA, 19 nt, Homo sapiens
ggacuugcccuucuggaaa

SEQ ID NO: 1590193 - RNA, 19 nt, Homo sapiens
uagagaagcugcagugaca

SEQ ID NO: 1590194 - RNA, 19 nt, Homo sapiens
ggaggaaagcugccuacua

SEQ ID NO: 1590195 - RNA, 19 nt, Homo sapiens
gcagugcacuaaauaacga

SEQ ID NO: 1590196 - RNA, 19 nt, Homo sapiens
cuaggaaacuggaagaaau

SEQ ID NO: 1590197 - RNA, 19 nt, Homo sapiens
gagggaaagugauacuaga

SEQ ID NO: 1590198 - RNA, 19 nt, Homo sapiens
ugaaggauccuguaaaugu

SEQ ID NO: 1590199 - RNA, 19 nt, Homo sapiens
ggacagaagcuggguuuga

SEQ ID NO: 1590200 - RNA, 19 nt, Homo sapiens
caacagaggggaagaaaua

SEQ ID NO: 1590201 - RNA, 19 nt, Homo sapiens
gagaacacauaccaucugu

SEQ ID NO: 1590202 - RNA, 19 nt, Homo sapiens
uaugaaggauccuguaaau

SEQ ID NO: 1590203 - RNA, 19 nt, Homo sapiens
gaaagcugccuacuacaga

SEQ ID NO: 1590204 - RNA, 19 nt, Homo sapiens
gauggugaauuuacucaug

SEQ ID NO: 1590205 - RNA, 19 nt, Homo sapiens
guaugucucuugugguauu

SEQ ID NO: 1590206 - RNA, 19 nt, Homo sapiens
ugaggguucuugcuuaauu

SEQ ID NO: 1590207 - RNA, 19 nt, Homo sapiens
ugacaaaucccauuacauc

SEQ ID NO: 1590208 - RNA, 19 nt, Homo sapiens
gaggguucuugcuuaauuu

SEQ ID NO: 1590209 - RNA, 19 nt, Homo sapiens
cuaugcaccucuaauguuu

SEQ ID NO: 1590210 - RNA, 19 nt, Homo sapiens
ucacuuuccuugcaaaugu

SEQ ID NO: 1590211 - RNA, 19 nt, Homo sapiens
ugaauuuacucaugagaug

SEQ ID NO: 1590212 - RNA, 19 nt, Homo sapiens
gagagggguuguuuuauaa

SEQ ID NO: 1590213 - RNA, 19 nt, Homo sapiens
cagaaggacuaaaggaaau

SEQ ID NO: 1590214 - RNA, 19 nt, Homo sapiens
caacauguuuccagcaagu

SEQ ID NO: 1590215 - RNA, 19 nt, Homo sapiens
caguguguguuucuuauuu

SEQ ID NO: 1590216 - RNA, 19 nt, Homo sapiens
ucaaagcucuguguauugu

SEQ ID NO: 1590217 - RNA, 19 nt, Homo sapiens
caaggugaauggugacaug

SEQ ID NO: 1590218 - RNA, 19 nt, Homo sapiens
gaugauacauuagagaaag

SEQ ID NO: 1590219 - RNA, 19 nt, Homo sapiens
uuaaaggucagcccacuua

SEQ ID NO: 1590220 - RNA, 19 nt, Homo sapiens
gaagguggaacaauggaaa

SEQ ID NO: 1590221 - RNA, 19 nt, Homo sapiens
cagcagcagugcacuaaau

SEQ ID NO: 1590222 - RNA, 19 nt, Homo sapiens
guggaacaauggaaagaaa

SEQ ID NO: 1590223 - RNA, 19 nt, Homo sapiens
gaacaccucguuucucauc

SEQ ID NO: 1590224 - RNA, 19 nt, Homo sapiens
gaacaauaaacccguacaa

SEQ ID NO: 1590225 - RNA, 19 nt, Homo sapiens
ucacaucucuccuccuaca

SEQ ID NO: 1590226 - RNA, 19 nt, Homo sapiens
cagcacaggguuaaaguaa

SEQ ID NO: 1590227 - RNA, 19 nt, Homo sapiens
ucaagaaugagaagacuuu

SEQ ID NO: 1590228 - RNA, 19 nt, Homo sapiens
caacggagacucugaagca

SEQ ID NO: 1590229 - RNA, 19 nt, Homo sapiens
ugacuccucugaagguaaa

SEQ ID NO: 1590230 - RNA, 19 nt, Homo sapiens
guugaggguucuugcuuaa

SEQ ID NO: 1590231 - RNA, 19 nt, Homo sapiens
ggugaucagagcaauguua

SEQ ID NO: 1590232 - RNA, 19 nt, Homo sapiens
gaaggaaguccgugcuaug

SEQ ID NO: 1590233 - RNA, 19 nt, Homo sapiens
gaaacagcccaaaccagaa

SEQ ID NO: 1590234 - RNA, 19 nt, Homo sapiens
gagaugauacauuagagaa

SEQ ID NO: 1590235 - RNA, 19 nt, Homo sapiens
aagcaugagugacaaguug

SEQ ID NO: 1590236 - RNA, 19 nt, Homo sapiens
ggacuaaaggaaaugagaa

SEQ ID NO: 1590237 - RNA, 19 nt, Homo sapiens
gaaacaggcacuggucuug

SEQ ID NO: 1590238 - RNA, 19 nt, Homo sapiens
agcauuugaugacgaauua

SEQ ID NO: 1590239 - RNA, 19 nt, Homo sapiens
gaaaguguacgucagaucu

SEQ ID NO: 1590240 - RNA, 19 nt, Homo sapiens
ggucauagaggcagaagga

SEQ ID NO: 1590241 - RNA, 19 nt, Homo sapiens
ccaugaggcugcccagaga

SEQ ID NO: 1590242 - RNA, 19 nt, Homo sapiens
ugccauaugugacaaauca

SEQ ID NO: 1590243 - RNA, 19 nt, Homo sapiens
acacaguacuggcugauuc

SEQ ID NO: 1590244 - RNA, 19 nt, Homo sapiens
gaucccagauucccuacug

SEQ ID NO: 1590245 - RNA, 19 nt, Homo sapiens
ccaaggaucagaagaggaa

SEQ ID NO: 1590246 - RNA, 19 nt, Homo sapiens
gaaacgcucucggccagau

SEQ ID NO: 1590247 - RNA, 19 nt, Homo sapiens
ccaccagcuuuaauuauuc

SEQ ID NO: 1590248 - RNA, 19 nt, Homo sapiens
ggugacaugcgucugguua

SEQ ID NO: 1590249 - RNA, 19 nt, Homo sapiens
gaugagaaacccaauugga

SEQ ID NO: 1590250 - RNA, 19 nt, Homo sapiens
cuacagagggcuacaguug

SEQ ID NO: 1590251 - RNA, 19 nt, Homo sapiens
ucagcccacuuaccagaua

SEQ ID NO: 1590252 - RNA, 19 nt, Homo sapiens
gagaaucagugcguauaca

SEQ ID NO: 1590253 - RNA, 19 nt, Homo sapiens
guggagagcugugggucua

SEQ ID NO: 1590254 - RNA, 19 nt, Homo sapiens
gaauuccucugcuugacau

SEQ ID NO: 1590255 - RNA, 19 nt, Homo sapiens
acgcagagcuucucacauc

SEQ ID NO: 1590256 - RNA, 19 nt, Homo sapiens
gcacugguccggucaucaa

SEQ ID NO: 1590257 - RNA, 19 nt, Homo sapiens
gcccguggguuugauugua

SEQ ID NO: 1590258 - RNA, 19 nt, Homo sapiens
gagcuucucacaucucaau

SEQ ID NO: 1590259 - RNA, 19 nt, Homo sapiens
gcagggcguugggaacaga

SEQ ID NO: 1590260 - RNA, 19 nt, Homo sapiens
cuuuagaguccaugaaaua

SEQ ID NO: 1590261 - RNA, 19 nt, Homo sapiens
augcuucucuccauuggua

SEQ ID NO: 1590262 - RNA, 19 nt, Homo sapiens
caggaugcuucucuccauu

SEQ ID NO: 1590263 - RNA, 19 nt, Homo sapiens
gagaggcccuggacaaccu

SEQ ID NO: 1590264 - RNA, 19 nt, Homo sapiens
guucuaagacgcagagcuu

SEQ ID NO: 1590265 - RNA, 19 nt, Homo sapiens
gcacuuuagaguccaugaa

SEQ ID NO: 1590266 - RNA, 19 nt, Homo sapiens
cagagcuucucacaucuca

SEQ ID NO: 1590267 - RNA, 19 nt, Homo sapiens
cuccauugguagcacuuua

SEQ ID NO: 1590268 - RNA, 19 nt, Homo sapiens
ucaggaugcuucucuccau

SEQ ID NO: 1590269 - RNA, 19 nt, Homo sapiens
caaggacugcgucuucugu

SEQ ID NO: 1590270 - RNA, 19 nt, Homo sapiens
cgucaaggacugcgucuuc

SEQ ID NO: 1590271 - RNA, 19 nt, Homo sapiens
ggaugcuucucuccauugg

SEQ ID NO: 1590272 - RNA, 19 nt, Homo sapiens
caaagucccgugggcaaga

SEQ ID NO: 1590273 - RNA, 19 nt, Homo sapiens
uccaugcaguguccuggua

SEQ ID NO: 1590274 - RNA, 19 nt, Homo sapiens
gcugcuuccuccacguuug

SEQ ID NO: 1590275 - RNA, 19 nt, Homo sapiens
cagcugcggccuugaggaa

SEQ ID NO: 1590276 - RNA, 19 nt, Homo sapiens
ugacgaggacugcuucaca

SEQ ID NO: 1590277 - RNA, 19 nt, Homo sapiens
ccuacagccucaccaccaa

SEQ ID NO: 1590278 - RNA, 19 nt, Homo sapiens
cccacuaaauggccagaga

SEQ ID NO: 1590279 - RNA, 19 nt, Homo sapiens
gaggaacccgucagcuaca

SEQ ID NO: 1590280 - RNA, 19 nt, Homo sapiens
cacuuuagaguccaugaaa

SEQ ID NO: 1590281 - RNA, 19 nt, Homo sapiens
cccguggguuugauuguau

SEQ ID NO: 1590282 - RNA, 19 nt, Homo sapiens
uugaggaacccgucagcua

SEQ ID NO: 1590283 - RNA, 19 nt, Homo sapiens
gcgaugacgaggacugcuu

SEQ ID NO: 1590284 - RNA, 19 nt, Homo sapiens
ucaaucaggaugcuucucu

SEQ ID NO: 1590285 - RNA, 19 nt, Homo sapiens
aggacugcgucuucuguga

SEQ ID NO: 1590286 - RNA, 19 nt, Homo sapiens
ggaaggcucugauuuggau

SEQ ID NO: 1590287 - RNA, 19 nt, Homo sapiens
gagggacgaugucaacgua

SEQ ID NO: 1590288 - RNA, 19 nt, Homo sapiens
gaaacugaaugccaaaggu

SEQ ID NO: 1590289 - RNA, 19 nt, Homo sapiens
cagcccagcuccuuucaaa

SEQ ID NO: 1590290 - RNA, 19 nt, Homo sapiens
ccacugcgcuggacaccuu

SEQ ID NO: 1590291 - RNA, 19 nt, Homo sapiens
agaaauggcugcccgagau

SEQ ID NO: 1590292 - RNA, 19 nt, Homo sapiens
gagggaaggcucugauuug

SEQ ID NO: 1590293 - RNA, 19 nt, Homo sapiens
ggagggaaggcucugauuu

SEQ ID NO: 1590294 - RNA, 19 nt, Homo sapiens
ggacaugggccucuaacug

SEQ ID NO: 1590295 - RNA, 19 nt, Homo sapiens
aaaccuggcacuuugauuu

SEQ ID NO: 1590296 - RNA, 19 nt, Homo sapiens
gaagaaacugaaugccaaa

SEQ ID NO: 1590297 - RNA, 19 nt, Homo sapiens
gaugucaacguacuaauuc

SEQ ID NO: 1590298 - RNA, 19 nt, Homo sapiens
gcaggaggccaaagacuuc

SEQ ID NO: 1590299 - RNA, 19 nt, Homo sapiens
guauuugacucggcuauuc

SEQ ID NO: 1590300 - RNA, 19 nt, Homo sapiens
gcucagccuugacgcagaa

SEQ ID NO: 1590301 - RNA, 19 nt, Homo sapiens
agucaaagcucacagaaaa

SEQ ID NO: 1590302 - RNA, 19 nt, Homo sapiens
uaacugcccacucugauau

SEQ ID NO: 1590303 - RNA, 19 nt, Homo sapiens
gagcuccggugcgcauuga

SEQ ID NO: 1590304 - RNA, 19 nt, Homo sapiens
gcagaagaacuugaaggaa

SEQ ID NO: 1590305 - RNA, 19 nt, Homo sapiens
ggacgaugucaacguacua

SEQ ID NO: 1590306 - RNA, 19 nt, Homo sapiens
ugacucggcuauucucagu

SEQ ID NO: 1590307 - RNA, 19 nt, Homo sapiens
cgaugucaacguacuaauu

SEQ ID NO: 1590308 - RNA, 19 nt, Homo sapiens
gcucugauuuggauuucuc

SEQ ID NO: 1590309 - RNA, 19 nt, Homo sapiens
cagcgggacaggaggauuu

SEQ ID NO: 1590310 - RNA, 19 nt, Homo sapiens
cuaacugcccacucugaua

SEQ ID NO: 1590311 - RNA, 19 nt, Homo sapiens
guaggcaggaggccaaaga

SEQ ID NO: 1590312 - RNA, 19 nt, Homo sapiens
guucuucugcuucguuuga

SEQ ID NO: 1590313 - RNA, 19 nt, Homo sapiens
ugacgcagaagaacuugaa

SEQ ID NO: 1590314 - RNA, 19 nt, Homo sapiens
ggacaccuucucugugcaa

SEQ ID NO: 1590315 - RNA, 19 nt, Homo sapiens
aaacaucacagagaaaugg

SEQ ID NO: 1590316 - RNA, 19 nt, Homo sapiens
ggaggccaaagacuucuga

SEQ ID NO: 1590317 - RNA, 19 nt, Homo sapiens
ggcaggaggccaaagacuu

SEQ ID NO: 1590318 - RNA, 19 nt, Homo sapiens
gaaauggcugcccgagauc

SEQ ID NO: 1590319 - RNA, 19 nt, Homo sapiens
gcuauucucagugccauug

SEQ ID NO: 1590320 - RNA, 19 nt, Homo sapiens
gcagccucaucgucagcua

SEQ ID NO: 1590321 - RNA, 19 nt, Homo sapiens
gacgaugucaacguacuaa

SEQ ID NO: 1590322 - RNA, 19 nt, Homo sapiens
ucccuuugcuacccggaua

SEQ ID NO: 1590323 - RNA, 19 nt, Homo sapiens
cgacuucguucccuuugcu

SEQ ID NO: 1590324 - RNA, 19 nt, Homo sapiens
gaccgacuucguucccuuu

SEQ ID NO: 1590325 - RNA, 19 nt, Homo sapiens
gggaaggcucugauuugga

SEQ ID NO: 1590326 - RNA, 19 nt, Homo sapiens
gggacgaugucaacguacu

SEQ ID NO: 1590327 - RNA, 19 nt, Homo sapiens
caccuucucugugcaaguc

SEQ ID NO: 1590328 - RNA, 19 nt, Homo sapiens
ccagucaaagcucacagaa

SEQ ID NO: 1590329 - RNA, 19 nt, Homo sapiens
cgcagaagaacuugaagga

SEQ ID NO: 1590330 - RNA, 19 nt, Homo sapiens
gaacucaucucgaccuucu

SEQ ID NO: 1590331 - RNA, 19 nt, Homo sapiens
ggacuucgccuucuucaug

SEQ ID NO: 1590332 - RNA, 19 nt, Homo sapiens
gcucggacacgcacacuuu

SEQ ID NO: 1590333 - RNA, 19 nt, Homo sapiens
acaaggacaagaagaagua

SEQ ID NO: 1590334 - RNA, 19 nt, Homo sapiens
agaaggaacuggagcaacu

SEQ ID NO: 1590335 - RNA, 19 nt, Homo sapiens
gggcgcaguuugccgagaa

SEQ ID NO: 1590336 - RNA, 19 nt, Homo sapiens
gacccacugugccaucuga

SEQ ID NO: 1590337 - RNA, 19 nt, Homo sapiens
gaucagcugcagauugguu

SEQ ID NO: 1590338 - RNA, 19 nt, Homo sapiens
ccacuucggcugcaugguu

SEQ ID NO: 1590339 - RNA, 19 nt, Homo sapiens
gaaguauuucuacaaguuc

SEQ ID NO: 1590340 - RNA, 19 nt, Homo sapiens
ccgaguacaagaagaagua

SEQ ID NO: 1590341 - RNA, 19 nt, Homo sapiens
gcauggacguggcuguucu

SEQ ID NO: 1590342 - RNA, 19 nt, Homo sapiens
cgacaucgagcgccacuuc

SEQ ID NO: 1590343 - RNA, 19 nt, Homo sapiens
gugcagacgcuguuucuca

SEQ ID NO: 1590344 - RNA, 19 nt, Homo sapiens
gcaguuugccgagaaggaa

SEQ ID NO: 1590345 - RNA, 19 nt, Homo sapiens
uggaggaacugagccaaga

SEQ ID NO: 1590346 - RNA, 19 nt, Homo sapiens
cccacaaccucccaaggaa

SEQ ID NO: 1590347 - RNA, 19 nt, Homo sapiens
cugaucagcugcagauugg

SEQ ID NO: 1590348 - RNA, 19 nt, Homo sapiens
ccaaagugcagacgcuguu

SEQ ID NO: 1590349 - RNA, 19 nt, Homo sapiens
aggacaagaagaaguauuu

SEQ ID NO: 1590350 - RNA, 19 nt, Homo sapiens
ggacaagaagaaguauuuc

SEQ ID NO: 1590351 - RNA, 19 nt, Homo sapiens
ucaccaagcgcuucaccaa

SEQ ID NO: 1590352 - RNA, 19 nt, Homo sapiens
cacuucggcugcaugguuu

SEQ ID NO: 1590353 - RNA, 19 nt, Homo sapiens
gcaaugacugacccacugu

SEQ ID NO: 1590354 - RNA, 19 nt, Homo sapiens
gacugcguaugcugaguga

SEQ ID NO: 1590355 - RNA, 19 nt, Homo sapiens
ccacuggaguugcuguacu

SEQ ID NO: 1590356 - RNA, 19 nt, Homo sapiens
cgcaggagaagaagaagaa

SEQ ID NO: 1590357 - RNA, 19 nt, Homo sapiens
caaagugcagacgcuguuu

SEQ ID NO: 1590358 - RNA, 19 nt, Homo sapiens
ccgacaaggacaagaagaa

SEQ ID NO: 1590359 - RNA, 19 nt, Homo sapiens
gacaaggacaagaagaagu

SEQ ID NO: 1590360 - RNA, 19 nt, Homo sapiens
cauggugaccuaccugugu

SEQ ID NO: 1590361 - RNA, 19 nt, Homo sapiens
uggcugcgcuggaggaacu

SEQ ID NO: 1590362 - RNA, 19 nt, Homo sapiens
gcaggaggacgcguuugug

SEQ ID NO: 1590363 - RNA, 19 nt, Homo sapiens
guucucaaggcaccacaaa

SEQ ID NO: 1590364 - RNA, 19 nt, Homo sapiens
caggagaagaagaagaaga

SEQ ID NO: 1590365 - RNA, 19 nt, Homo sapiens
gacaggcacugcggcugau

SEQ ID NO: 1590366 - RNA, 19 nt, Homo sapiens
gcgccuaccgcuucgugaa

SEQ ID NO: 1590367 - RNA, 19 nt, Homo sapiens
gcgcaggagaagaagaaga

SEQ ID NO: 1590368 - RNA, 19 nt, Homo sapiens
gaaggaacuggagcaacug

SEQ ID NO: 1590369 - RNA, 19 nt, Homo sapiens
ccaagaccaccacgucagu

SEQ ID NO: 1590370 - RNA, 19 nt, Homo sapiens
ggacacgcacacuuucaac

SEQ ID NO: 1590371 - RNA, 19 nt, Homo sapiens
agggagaggagcccaacua

SEQ ID NO: 1590372 - RNA, 19 nt, Homo sapiens
cgacaaggacaagaagaag

SEQ ID NO: 1590373 - RNA, 19 nt, Homo sapiens
gaacuugcacgugcuggaa

SEQ ID NO: 1590374 - RNA, 19 nt, Homo sapiens
ggucuugccuuuguuugga

SEQ ID NO: 1590375 - RNA, 19 nt, Homo sapiens
guaacggcgucacugaugu

SEQ ID NO: 1590376 - RNA, 19 nt, Homo sapiens
gguaacggcgucacugaug

SEQ ID NO: 1590377 - RNA, 19 nt, Homo sapiens
ggaguucggacgcgucuca

SEQ ID NO: 1590378 - RNA, 19 nt, Homo sapiens
gacaugucaucagcaguga

SEQ ID NO: 1590379 - RNA, 19 nt, Homo sapiens
ccgcuuaucaaacuccuaa

SEQ ID NO: 1590380 - RNA, 19 nt, Homo sapiens
ggucacaggacaugucauc

SEQ ID NO: 1590381 - RNA, 19 nt, Homo sapiens
gccuuugguuggugaauuc

SEQ ID NO: 1590382 - RNA, 19 nt, Homo sapiens
caugucaucagcagugaaa

SEQ ID NO: 1590383 - RNA, 19 nt, Homo sapiens
cuacucuucccuccgcuua

SEQ ID NO: 1590384 - RNA, 19 nt, Homo sapiens
caccaucccacgcuacuga

SEQ ID NO: 1590385 - RNA, 19 nt, Homo sapiens
caucagcagugaaaagguu

SEQ ID NO: 1590386 - RNA, 19 nt, Homo sapiens
caucaccccugcugccuuu

SEQ ID NO: 1590387 - RNA, 19 nt, Homo sapiens
uguccaggguugugccuau

SEQ ID NO: 1590388 - RNA, 19 nt, Homo sapiens
gcugagccuuucccuugca

SEQ ID NO: 1590389 - RNA, 19 nt, Homo sapiens
uuuccugccuucagaacuu

SEQ ID NO: 1590390 - RNA, 19 nt, Homo sapiens
guccaggguugugccuauu

SEQ ID NO: 1590391 - RNA, 19 nt, Homo sapiens
ccaggguugugccuauugg

SEQ ID NO: 1590392 - RNA, 19 nt, Homo sapiens
gaaagaaacccuacaaaug

SEQ ID NO: 1590393 - RNA, 19 nt, Homo sapiens
gacaugagauggugaauga

SEQ ID NO: 1590394 - RNA, 19 nt, Homo sapiens
ucucaaaccuuacugaaua

SEQ ID NO: 1590395 - RNA, 19 nt, Homo sapiens
gaacuggaaugugugauaa

SEQ ID NO: 1590396 - RNA, 19 nt, Homo sapiens
ggagaaacccuacaaaugu

SEQ ID NO: 1590397 - RNA, 19 nt, Homo sapiens
cuacaaaugugaagaaugu

SEQ ID NO: 1590398 - RNA, 19 nt, Homo sapiens
cuacaaaugugaagaaugu

SEQ ID NO: 1590399 - RNA, 19 nt, Homo sapiens
cuacaaaugugaagaaugu

SEQ ID NO: 1590400 - RNA, 19 nt, Homo sapiens
cuacaaaugugaagaaugu

SEQ ID NO: 1590401 - RNA, 19 nt, Homo sapiens
cuacaaaugucaagaaugu

SEQ ID NO: 1590402 - RNA, 19 nt, Homo sapiens
gugagaaacucuacaaaug

SEQ ID NO: 1590403 - RNA, 19 nt, Homo sapiens
cuacagaacuggaaugugu

SEQ ID NO: 1590404 - RNA, 19 nt, Homo sapiens
gaaauuauaccaaggugaa

SEQ ID NO: 1590405 - RNA, 19 nt, Homo sapiens
ggaaagaaacccuacaaau

SEQ ID NO: 1590406 - RNA, 19 nt, Homo sapiens
gagagaaacccuacaaaug

SEQ ID NO: 1590407 - RNA, 19 nt, Homo sapiens
gaagagaaacccuacaaau

SEQ ID NO: 1590408 - RNA, 19 nt, Homo sapiens
gagagaaacccuacaaaug

SEQ ID NO: 1590409 - RNA, 19 nt, Homo sapiens
cuucaaagcuuacuaaaca

SEQ ID NO: 1590410 - RNA, 19 nt, Homo sapiens
caagggagguuauaaugga

SEQ ID NO: 1590411 - RNA, 19 nt, Homo sapiens
uaaccaaucuucaaagcuu

SEQ ID NO: 1590412 - RNA, 19 nt, Homo sapiens
aaacacuccucaucccuua

SEQ ID NO: 1590413 - RNA, 19 nt, Homo sapiens
gagagaaacuacagaacug

SEQ ID NO: 1590414 - RNA, 19 nt, Homo sapiens
uaaccaaucugcaaaccuu

SEQ ID NO: 1590415 - RNA, 19 nt, Homo sapiens
gagagaaacccuaugaaug

SEQ ID NO: 1590416 - RNA, 19 nt, Homo sapiens
gagaaacccuacaaaugug

SEQ ID NO: 1590417 - RNA, 19 nt, Homo sapiens
gagaaacccuacaaaugug

SEQ ID NO: 1590418 - RNA, 19 nt, Homo sapiens
gagaaacccuacaaaugug

SEQ ID NO: 1590419 - RNA, 19 nt, Homo sapiens
aaagaaacccuacaaaugu

SEQ ID NO: 1590420 - RNA, 19 nt, Homo sapiens
gagagaaaccauacaaaug

SEQ ID NO: 1590421 - RNA, 19 nt, Homo sapiens
ccugugaccugcagaaauu

SEQ ID NO: 1590422 - RNA, 19 nt, Homo sapiens
ccucaaaacuuacugaaua

SEQ ID NO: 1590423 - RNA, 19 nt, Homo sapiens
gagcaacccuacaaaugug

SEQ ID NO: 1590424 - RNA, 19 nt, Homo sapiens
gagcaacccuacauaugug

SEQ ID NO: 1590425 - RNA, 19 nt, Homo sapiens
aaccaguucucaaaucuua

SEQ ID NO: 1590426 - RNA, 19 nt, Homo sapiens
caaggugaauuucugcaaa

SEQ ID NO: 1590427 - RNA, 19 nt, Homo sapiens
gcacagcggaauuuaugua

SEQ ID NO: 1590428 - RNA, 19 nt, Homo sapiens
cuacaagugugaagaaugu

SEQ ID NO: 1590429 - RNA, 19 nt, Homo sapiens
ccucaaaucuuacggaaca

SEQ ID NO: 1590430 - RNA, 19 nt, Homo sapiens
gagaaacucuacaaauguc

SEQ ID NO: 1590431 - RNA, 19 nt, Homo sapiens
ggagagaaacccuaugaau

SEQ ID NO: 1590432 - RNA, 19 nt, Homo sapiens
gggagaaacccuacaaaug

SEQ ID NO: 1590433 - RNA, 19 nt, Homo sapiens
ggagagaaacccuacaaau

SEQ ID NO: 1590434 - RNA, 19 nt, Homo sapiens
ucucaaaucuuacuacaca

SEQ ID NO: 1590435 - RNA, 19 nt, Homo sapiens
ggagagaaacccuacaaau

SEQ ID NO: 1590436 - RNA, 19 nt, Homo sapiens
cugcaaaccuuacuaaaca

SEQ ID NO: 1590437 - RNA, 19 nt, Homo sapiens
ugacaaagcuuuuaaccaa

SEQ ID NO: 1590438 - RNA, 19 nt, Homo sapiens
gagagcaacccuacaaaug

SEQ ID NO: 1590439 - RNA, 19 nt, Homo sapiens
cuacaaaugugaagaaugc

SEQ ID NO: 1590440 - RNA, 19 nt, Homo sapiens
ggccagagcagaacauaaa

SEQ ID NO: 1590441 - RNA, 19 nt, Homo sapiens
gcaaaccuuacuaaacaua

SEQ ID NO: 1590442 - RNA, 19 nt, Homo sapiens
gagaaaccauacaaaugug

SEQ ID NO: 1590443 - RNA, 19 nt, Homo sapiens
ggacuuaaccaauguuuac

SEQ ID NO: 1590444 - RNA, 19 nt, Homo sapiens
gcacaagggagguuauaau

SEQ ID NO: 1590445 - RNA, 19 nt, Homo sapiens
aaccaauucucaaaccuua

SEQ ID NO: 1590446 - RNA, 19 nt, Homo sapiens
acaccuaacucgacaugaa

SEQ ID NO: 1590447 - RNA, 19 nt, Homo sapiens
gaaaugggacuguugacau

SEQ ID NO: 1590448 - RNA, 19 nt, Homo sapiens
ggagagcaacccuacauau

SEQ ID NO: 1590449 - RNA, 19 nt, Homo sapiens
caaagccucuaaccaguuc

SEQ ID NO: 1590450 - RNA, 19 nt, Homo sapiens
gcaaaugugaagaauguga

SEQ ID NO: 1590451 - RNA, 19 nt, Homo sapiens
agagaaacccuaugaaugu

SEQ ID NO: 1590452 - RNA, 19 nt, Homo sapiens
agagaaacccuacaaaugu

SEQ ID NO: 1590453 - RNA, 19 nt, Homo sapiens
agagaaacccuacaaaugu

SEQ ID NO: 1590454 - RNA, 19 nt, Homo sapiens
gagaauucauacuggagaa

SEQ ID NO: 1590455 - RNA, 19 nt, Homo sapiens
agagaaacccuacaaaugu

SEQ ID NO: 1590456 - RNA, 19 nt, Homo sapiens
cugcaaaugugaagaaugu

SEQ ID NO: 1590457 - RNA, 19 nt, Homo sapiens
gcaaaauguuucaauguga

SEQ ID NO: 1590458 - RNA, 19 nt, Homo sapiens
gagaaacccuaugaaugug

SEQ ID NO: 1590459 - RNA, 19 nt, Homo sapiens
ggagagauacccuacaagu

SEQ ID NO: 1590460 - RNA, 19 nt, Homo sapiens
aaacacuccucagcccuua

SEQ ID NO: 1590461 - RNA, 19 nt, Homo sapiens
aaccgauccucaaaucuua

SEQ ID NO: 1590462 - RNA, 19 nt, Homo sapiens
gagagcaacccuacauaug

SEQ ID NO: 1590463 - RNA, 19 nt, Homo sapiens
auaauggacuuaaccaaug

SEQ ID NO: 1590464 - RNA, 19 nt, Homo sapiens
gcaaagccucuaaccaguu

SEQ ID NO: 1590465 - RNA, 19 nt, Homo sapiens
ugacagaacuuuuaaccaa

SEQ ID NO: 1590466 - RNA, 19 nt, Homo sapiens
ggauguggccauagaauuc

SEQ ID NO: 1590467 - RNA, 19 nt, Homo sapiens
acacugagaagauaugaaa

SEQ ID NO: 1590468 - RNA, 19 nt, Homo sapiens
ccucaucccuuacuacaca

SEQ ID NO: 1590469 - RNA, 19 nt, Homo sapiens
ccucaacccuuacuacaca

SEQ ID NO: 1590470 - RNA, 19 nt, Homo sapiens
ccucacaccuuacuacaca

SEQ ID NO: 1590471 - RNA, 19 nt, Homo sapiens
cgagagaaaccauacaaau

SEQ ID NO: 1590472 - RNA, 19 nt, Homo sapiens
ggagagcaacccuacaaau

SEQ ID NO: 1590473 - RNA, 19 nt, Homo sapiens
aaccaguccucacaccuua

SEQ ID NO: 1590474 - RNA, 19 nt, Homo sapiens
agagaaaccauacaaaugu

SEQ ID NO: 1590475 - RNA, 19 nt, Homo sapiens
ucaaugugaugaauaugug

SEQ ID NO: 1590476 - RNA, 19 nt, Homo sapiens
ucaccugucuggagcaaga

SEQ ID NO: 1590477 - RNA, 19 nt, Homo sapiens
aagagaaacccuacaaaug

SEQ ID NO: 1590478 - RNA, 19 nt, Homo sapiens
uaaccgauccucaaaucuu

SEQ ID NO: 1590479 - RNA, 19 nt, Homo sapiens
cauaagagaauucauacug

SEQ ID NO: 1590480 - RNA, 19 nt, Homo sapiens
uaaccaauguuuaccaacu

SEQ ID NO: 1590481 - RNA, 19 nt, Homo sapiens
gagcagaacauaaaagauu

SEQ ID NO: 1590482 - RNA, 19 nt, Homo sapiens
ggagagaaacuacagaacu

SEQ ID NO: 1590483 - RNA, 19 nt, Homo sapiens
ccucagcccuuacuacaca

SEQ ID NO: 1590484 - RNA, 19 nt, Homo sapiens
agauuaugcucgagagaaa

SEQ ID NO: 1590485 - RNA, 19 nt, Homo sapiens
gaaugugacagaacuuuua

SEQ ID NO: 1590486 - RNA, 19 nt, Homo sapiens
ucaagaaugugacagaacu

SEQ ID NO: 1590487 - RNA, 19 nt, Homo sapiens
uaacucgacaugaaagaaa

SEQ ID NO: 1590488 - RNA, 19 nt, Homo sapiens
agagauacccuacaagugu

SEQ ID NO: 1590489 - RNA, 19 nt, Homo sapiens
uuaaaaggcuguaaaagug

SEQ ID NO: 1590490 - RNA, 19 nt, Homo sapiens
guaaaaguguggaugaaug

SEQ ID NO: 1590491 - RNA, 19 nt, Homo sapiens
ugagagaugugacaaagcu

SEQ ID NO: 1590492 - RNA, 19 nt, Homo sapiens
gaacugauauguugcaaug

SEQ ID NO: 1590493 - RNA, 19 nt, Homo sapiens
gcaaaguaaucuaguagua

SEQ ID NO: 1590494 - RNA, 19 nt, Homo sapiens
gaaugaagcucgacugaga

SEQ ID NO: 1590495 - RNA, 19 nt, Homo sapiens
ggagggaacugauauguug

SEQ ID NO: 1590496 - RNA, 19 nt, Homo sapiens
gaccauuacuguagaguua

SEQ ID NO: 1590497 - RNA, 19 nt, Homo sapiens
caacucaaauucaauguga

SEQ ID NO: 1590498 - RNA, 19 nt, Homo sapiens
caacugacauccucaauag

SEQ ID NO: 1590499 - RNA, 19 nt, Homo sapiens
ggaaaguccugaagaaauc

SEQ ID NO: 1590500 - RNA, 19 nt, Homo sapiens
ucaaguaggucucuuucua

SEQ ID NO: 1590501 - RNA, 19 nt, Homo sapiens
gaagaaauccagugguuug

SEQ ID NO: 1590502 - RNA, 19 nt, Homo sapiens
cgaagacucuguuauuaga

SEQ ID NO: 1590503 - RNA, 19 nt, Homo sapiens
cacgaagacucuguuauua

SEQ ID NO: 1590504 - RNA, 19 nt, Homo sapiens
aaacaaacaugaagcaaag

SEQ ID NO: 1590505 - RNA, 19 nt, Homo sapiens
gcaaaggaguagagagaau

SEQ ID NO: 1590506 - RNA, 19 nt, Homo sapiens
acagagaacuugcaaagga

SEQ ID NO: 1590507 - RNA, 19 nt, Homo sapiens
gaacaucaacaauuaggaa

SEQ ID NO: 1590508 - RNA, 19 nt, Homo sapiens
gccaugggcuucacuggua

SEQ ID NO: 1590509 - RNA, 19 nt, Homo sapiens
guaaagaaacccuggauau

SEQ ID NO: 1590510 - RNA, 19 nt, Homo sapiens
guuagaggcugaggauaua

SEQ ID NO: 1590511 - RNA, 19 nt, Homo sapiens
gagguguucuccuuuauau

SEQ ID NO: 1590512 - RNA, 19 nt, Homo sapiens
gagcugggcugcuuagaca

SEQ ID NO: 1590513 - RNA, 19 nt, Homo sapiens
gcaaaagauuguugucaua

SEQ ID NO: 1590514 - RNA, 19 nt, Homo sapiens
guaggucucuuucuagaug

SEQ ID NO: 1590515 - RNA, 19 nt, Homo sapiens
gaucugggcccuacugaaa

SEQ ID NO: 1590516 - RNA, 19 nt, Homo sapiens
gcacaacaccauauggaaa

SEQ ID NO: 1590517 - RNA, 19 nt, Homo sapiens
acaaguguguccaauuuaa

SEQ ID NO: 1590518 - RNA, 19 nt, Homo sapiens
ggaggaaucugaugcaacu

SEQ ID NO: 1590519 - RNA, 19 nt, Homo sapiens
agacauagcggaacagaaa

SEQ ID NO: 1590520 - RNA, 19 nt, Homo sapiens
gcaacugacauccucaaua

SEQ ID NO: 1590521 - RNA, 19 nt, Homo sapiens
gaaggucgggccucaagua

SEQ ID NO: 1590522 - RNA, 19 nt, Homo sapiens
gaagcucgacugagaauug

SEQ ID NO: 1590523 - RNA, 19 nt, Homo sapiens
cagcauaggugcaacaagu

SEQ ID NO: 1590524 - RNA, 19 nt, Homo sapiens
ggagggcagugcuuuaugu

SEQ ID NO: 1590525 - RNA, 19 nt, Homo sapiens
ucaguugucucauucugua

SEQ ID NO: 1590526 - RNA, 19 nt, Homo sapiens
uaagugggcugaagaacug

SEQ ID NO: 1590527 - RNA, 19 nt, Homo sapiens
caauggguuugcucaauuu

SEQ ID NO: 1590528 - RNA, 19 nt, Homo sapiens
gguggaaaguccugaagaa

SEQ ID NO: 1590529 - RNA, 19 nt, Homo sapiens
ucacgaagacucuguuauu

SEQ ID NO: 1590530 - RNA, 19 nt, Homo sapiens
gggcuucaguugucucauu

SEQ ID NO: 1590531 - RNA, 19 nt, Homo sapiens
gaacugauugcugccuuua

SEQ ID NO: 1590532 - RNA, 19 nt, Homo sapiens
uaaagaaacccuggauauu

SEQ ID NO: 1590533 - RNA, 19 nt, Homo sapiens
gcaacaaguaguaaagaaa

SEQ ID NO: 1590534 - RNA, 19 nt, Homo sapiens
ccacagaggcagaaaguug

SEQ ID NO: 1590535 - RNA, 19 nt, Homo sapiens
gaagccaaguguacucugu

SEQ ID NO: 1590536 - RNA, 19 nt, Homo sapiens
uggaguggcugcaaacaaa

SEQ ID NO: 1590537 - RNA, 19 nt, Homo sapiens
gcacauacuaguaacaaau

SEQ ID NO: 1590538 - RNA, 19 nt, Homo sapiens
gcugcacggugucauuuaa

SEQ ID NO: 1590539 - RNA, 19 nt, Homo sapiens
gguguucuccuuuauauug

SEQ ID NO: 1590540 - RNA, 19 nt, Homo sapiens
gaaugaaucagugaguuaa

SEQ ID NO: 1590541 - RNA, 19 nt, Homo sapiens
guagcucccugaccauuug

SEQ ID NO: 1590542 - RNA, 19 nt, Homo sapiens
gcacacauuuacugagcuu

SEQ ID NO: 1590543 - RNA, 19 nt, Homo sapiens
uacuggaacucaucucaua

SEQ ID NO: 1590544 - RNA, 19 nt, Homo sapiens
ugaaugaaucagugaguua

SEQ ID NO: 1590545 - RNA, 19 nt, Homo sapiens
ccucugaacuuuaaacucu

SEQ ID NO: 1590546 - RNA, 19 nt, Homo sapiens
ggcugaggauauagaaaua

SEQ ID NO: 1590547 - RNA, 19 nt, Homo sapiens
gaaaagcaagacagaaaua

SEQ ID NO: 1590548 - RNA, 19 nt, Homo sapiens
gaacagaaaacccuucaaa

SEQ ID NO: 1590549 - RNA, 19 nt, Homo sapiens
aaucauagcacuaacauuc

SEQ ID NO: 1590550 - RNA, 19 nt, Homo sapiens
uaaccaaugcccuuaggua

SEQ ID NO: 1590551 - RNA, 19 nt, Homo sapiens
caucugcucuguuuacaca

SEQ ID NO: 1590552 - RNA, 19 nt, Homo sapiens
gauucacccuaaccaaauu

SEQ ID NO: 1590553 - RNA, 19 nt, Homo sapiens
gugagugaauguuuguaaa

SEQ ID NO: 1590554 - RNA, 19 nt, Homo sapiens
uguacucugucaucacuua

SEQ ID NO: 1590555 - RNA, 19 nt, Homo sapiens
aaagaaacccuggauauuc

SEQ ID NO: 1590556 - RNA, 19 nt, Homo sapiens
guccagcucuuccuuuaug

SEQ ID NO: 1590557 - RNA, 19 nt, Homo sapiens
ggaauaaaauagcuguuug

SEQ ID NO: 1590558 - RNA, 19 nt, Homo sapiens
gaccauuuguggaaucguu

SEQ ID NO: 1590559 - RNA, 19 nt, Homo sapiens
ugucaucacuuaauaaugc

SEQ ID NO: 1590560 - RNA, 19 nt, Homo sapiens
gcccagcacauacuaguaa

SEQ ID NO: 1590561 - RNA, 19 nt, Homo sapiens
guuagugagugaauguuug

SEQ ID NO: 1590562 - RNA, 19 nt, Homo sapiens
caacaagaggguaaaguuc

SEQ ID NO: 1590563 - RNA, 19 nt, Homo sapiens
cugaagaaauccagugguu

SEQ ID NO: 1590564 - RNA, 19 nt, Homo sapiens
agaaaacccuucaaaaguu

SEQ ID NO: 1590565 - RNA, 19 nt, Homo sapiens
gagaagcggcagaaacaga

SEQ ID NO: 1590566 - RNA, 19 nt, Homo sapiens
gcaaugcaaaguaaucuag

SEQ ID NO: 1590567 - RNA, 19 nt, Homo sapiens
caauauggguaaccaaugc

SEQ ID NO: 1590568 - RNA, 19 nt, Homo sapiens
gaguagagagaauguuuga

SEQ ID NO: 1590569 - RNA, 19 nt, Homo sapiens
uacauugacuuucgagaug

SEQ ID NO: 1590570 - RNA, 19 nt, Homo sapiens
ccucaucccaucacaagua

SEQ ID NO: 1590571 - RNA, 19 nt, Homo sapiens
acucugucaucacuuaaua

SEQ ID NO: 1590572 - RNA, 19 nt, Homo sapiens
uuacugagcuucuguuacg

SEQ ID NO: 1590573 - RNA, 19 nt, Homo sapiens
acugauugcugccuuuaaa

SEQ ID NO: 1590574 - RNA, 19 nt, Homo sapiens
ggucgggccucaaguaggu

SEQ ID NO: 1590575 - RNA, 19 nt, Homo sapiens
aaacuugaacaaccaauga

SEQ ID NO: 1590576 - RNA, 19 nt, Homo sapiens
gcugaaagcgucucuagca

SEQ ID NO: 1590577 - RNA, 19 nt, Homo sapiens
gaaaacccuucaaaaguuc

SEQ ID NO: 1590578 - RNA, 19 nt, Homo sapiens
uguguccucugaacuuuaa

SEQ ID NO: 1590579 - RNA, 19 nt, Homo sapiens
ccuaauacauuuucacuga

SEQ ID NO: 1590580 - RNA, 19 nt, Homo sapiens
gcucguuccuggcaacuag

SEQ ID NO: 1590581 - RNA, 19 nt, Homo sapiens
cuugugagguuggauuuaa

SEQ ID NO: 1590582 - RNA, 19 nt, Homo sapiens
caaguguacucugucauca

SEQ ID NO: 1590583 - RNA, 19 nt, Homo sapiens
guagaucugguguacauug

SEQ ID NO: 1590584 - RNA, 19 nt, Homo sapiens
gaaggcacaacaccauaug

SEQ ID NO: 1590585 - RNA, 19 nt, Homo sapiens
caucagcucugcaccaaaa

SEQ ID NO: 1590586 - RNA, 19 nt, Homo sapiens
gcucgacugagaauuguaa

SEQ ID NO: 1590587 - RNA, 19 nt, Homo sapiens
guacauugacuuucgagau

SEQ ID NO: 1590588 - RNA, 19 nt, Homo sapiens
gcuagugagccaacacaaa

SEQ ID NO: 1590589 - RNA, 19 nt, Homo sapiens
caaguguguccaauuuaaa

SEQ ID NO: 1590590 - RNA, 19 nt, Homo sapiens
gguagggagggaacugaua

SEQ ID NO: 1590591 - RNA, 19 nt, Homo sapiens
uuccugagcuuugaauauu

SEQ ID NO: 1590592 - RNA, 19 nt, Homo sapiens
gcagaaacgugauuauaga

SEQ ID NO: 1590593 - RNA, 19 nt, Homo sapiens
gcagaaagaugaugaagca

SEQ ID NO: 1590594 - RNA, 19 nt, Homo sapiens
gaaagaugaugaagcagaa

SEQ ID NO: 1590595 - RNA, 19 nt, Homo sapiens
gaagaggaagaacaaauua

SEQ ID NO: 1590596 - RNA, 19 nt, Homo sapiens
gaaagaacuugaaccuaug

SEQ ID NO: 1590597 - RNA, 19 nt, Homo sapiens
agaaagaacuugaaccuau

SEQ ID NO: 1590598 - RNA, 19 nt, Homo sapiens
ucuaugaucuguugaauga

SEQ ID NO: 1590599 - RNA, 19 nt, Homo sapiens
ggaagaagaaggagaagaa

SEQ ID NO: 1590600 - RNA, 19 nt, Homo sapiens
ggaagaggaagaacaaauu

SEQ ID NO: 1590601 - RNA, 19 nt, Homo sapiens
guucagggaucgccucuaa

SEQ ID NO: 1590602 - RNA, 19 nt, Homo sapiens
guucagggaucgccucuaa

SEQ ID NO: 1590603 - RNA, 19 nt, Homo sapiens
ggaggaagauguaacugau

SEQ ID NO: 1590604 - RNA, 19 nt, Homo sapiens
gaaagaagaggaggaagaa

SEQ ID NO: 1590605 - RNA, 19 nt, Homo sapiens
ccaugaagcuagaacauau

SEQ ID NO: 1590606 - RNA, 19 nt, Homo sapiens
ggaagaagaagaagaggaa

SEQ ID NO: 1590607 - RNA, 19 nt, Homo sapiens
gagcacaacuugagcuaca

SEQ ID NO: 1590608 - RNA, 19 nt, Homo sapiens
gaacuugaaccuauguuau

SEQ ID NO: 1590609 - RNA, 19 nt, Homo sapiens
ggaagaggaagaagaagaa

SEQ ID NO: 1590610 - RNA, 19 nt, Homo sapiens
gaaagcacgggcauagaaa

SEQ ID NO: 1590611 - RNA, 19 nt, Homo sapiens
uaaacuacaugacaguguu

SEQ ID NO: 1590612 - RNA, 19 nt, Homo sapiens
caaggacacuaaagacaau

SEQ ID NO: 1590613 - RNA, 19 nt, Homo sapiens
cagagaagcagaaagauga

SEQ ID NO: 1590614 - RNA, 19 nt, Homo sapiens
cgaagaagcacacaggaaa

SEQ ID NO: 1590615 - RNA, 19 nt, Homo sapiens
aagaauacaucgcagagaa

SEQ ID NO: 1590616 - RNA, 19 nt, Homo sapiens
gaaacgugauuauagacau

SEQ ID NO: 1590617 - RNA, 19 nt, Homo sapiens
gcacuucauugucucuuca

SEQ ID NO: 1590618 - RNA, 19 nt, Homo sapiens
gagaagaaacagaagaaga

SEQ ID NO: 1590619 - RNA, 19 nt, Homo sapiens
ucacuugucuguuaaaugc

SEQ ID NO: 1590620 - RNA, 19 nt, Homo sapiens
gagaugaagccgcuacuug

SEQ ID NO: 1590621 - RNA, 19 nt, Homo sapiens
uauugcagcugacauuaaa

SEQ ID NO: 1590622 - RNA, 19 nt, Homo sapiens
ggcagggauugcacaguua

SEQ ID NO: 1590623 - RNA, 19 nt, Homo sapiens
ggaggaagaagaaggagaa

SEQ ID NO: 1590624 - RNA, 19 nt, Homo sapiens
cgguauagcuccucuguca

SEQ ID NO: 1590625 - RNA, 19 nt, Homo sapiens
gcacaguuauguacauggu

SEQ ID NO: 1590626 - RNA, 19 nt, Homo sapiens
ugccagaccucguuucuau

SEQ ID NO: 1590627 - RNA, 19 nt, Homo sapiens
caucauuucuuccagugaa

SEQ ID NO: 1590628 - RNA, 19 nt, Homo sapiens
cagaagagguggcaacaac

SEQ ID NO: 1590629 - RNA, 19 nt, Homo sapiens
gcagagaagcagaaagaug

SEQ ID NO: 1590630 - RNA, 19 nt, Homo sapiens
caacuugagcuacaguaaa

SEQ ID NO: 1590631 - RNA, 19 nt, Homo sapiens
ccuagacacuucugugaga

SEQ ID NO: 1590632 - RNA, 19 nt, Homo sapiens
gaagaaagaacuugaaccu

SEQ ID NO: 1590633 - RNA, 19 nt, Homo sapiens
ucuucaaccucuguuauua

SEQ ID NO: 1590634 - RNA, 19 nt, Homo sapiens
ggagaaagaagaggaggaa

SEQ ID NO: 1590635 - RNA, 19 nt, Homo sapiens
gcacgggcauagaaaagua

SEQ ID NO: 1590636 - RNA, 19 nt, Homo sapiens
gaaugaauccuagacacuu

SEQ ID NO: 1590637 - RNA, 19 nt, Homo sapiens
aaaccaagaacacaauuga

SEQ ID NO: 1590638 - RNA, 19 nt, Homo sapiens
agaagaaggagaagaagaa

SEQ ID NO: 1590639 - RNA, 19 nt, Homo sapiens
gaauguccuuaaagaauac

SEQ ID NO: 1590640 - RNA, 19 nt, Homo sapiens
gaacacacggggauucaua

SEQ ID NO: 1590641 - RNA, 19 nt, Homo sapiens
aggaagauguaacugauga

SEQ ID NO: 1590642 - RNA, 19 nt, Homo sapiens
guuggaagcucaaguuagg

SEQ ID NO: 1590643 - RNA, 19 nt, Homo sapiens
gagcuacaguaaacuacau

SEQ ID NO: 1590644 - RNA, 19 nt, Homo sapiens
caauugaacgugcuuugaa

SEQ ID NO: 1590645 - RNA, 19 nt, Homo sapiens
ccagaccucguuucuauga

SEQ ID NO: 1590646 - RNA, 19 nt, Homo sapiens
gcaggaagcgcagcaggaa

SEQ ID NO: 1590647 - RNA, 19 nt, Homo sapiens
ccaaggacacuaaagacaa

SEQ ID NO: 1590648 - RNA, 19 nt, Homo sapiens
ggaagaacaaauuaaagca

SEQ ID NO: 1590649 - RNA, 19 nt, Homo sapiens
gcaggaagcgcagcaggaa

SEQ ID NO: 1590650 - RNA, 19 nt, Homo sapiens
ucaccucuguggaucugua

SEQ ID NO: 1590651 - RNA, 19 nt, Homo sapiens
gauuucaguucaccucugu

SEQ ID NO: 1590652 - RNA, 19 nt, Homo sapiens
cagcagaaguaauaguagu

SEQ ID NO: 1590653 - RNA, 19 nt, Homo sapiens
ggcagaaacgugauuauag

SEQ ID NO: 1590654 - RNA, 19 nt, Homo sapiens
gaagcuagaacauauugca

SEQ ID NO: 1590655 - RNA, 19 nt, Homo sapiens
gggaggaagauguaacuga

SEQ ID NO: 1590656 - RNA, 19 nt, Homo sapiens
agaaagcacgggcauagaa

SEQ ID NO: 1590657 - RNA, 19 nt, Homo sapiens
guagaaagcacgggcauag

SEQ ID NO: 1590658 - RNA, 19 nt, Homo sapiens
gccgcuacuugagcaauua

SEQ ID NO: 1590659 - RNA, 19 nt, Homo sapiens
gaacauauugcagcugaca

SEQ ID NO: 1590660 - RNA, 19 nt, Homo sapiens
caggaaggcugccaaagcu

SEQ ID NO: 1590661 - RNA, 19 nt, Homo sapiens
caggaaggcugccaaagcu

SEQ ID NO: 1590662 - RNA, 19 nt, Homo sapiens
agaaggagaagaaacagaa

SEQ ID NO: 1590663 - RNA, 19 nt, Homo sapiens
agaaggaggaggagaagaa

SEQ ID NO: 1590664 - RNA, 19 nt, Homo sapiens
aauugaacgugcuuugaaa

SEQ ID NO: 1590665 - RNA, 19 nt, Homo sapiens
gaagaagcacacaggaaag

SEQ ID NO: 1590666 - RNA, 19 nt, Homo sapiens
gcgaagaagcacacaggaa

SEQ ID NO: 1590667 - RNA, 19 nt, Homo sapiens
ggacacuaaagacaauuau

SEQ ID NO: 1590668 - RNA, 19 nt, Homo sapiens
ugaugaaugugaggaaaga

SEQ ID NO: 1590669 - RNA, 19 nt, Homo sapiens
aaacaagggaggaagaugu

SEQ ID NO: 1590670 - RNA, 19 nt, Homo sapiens
aggcagggauugcacaguu

SEQ ID NO: 1590671 - RNA, 19 nt, Homo sapiens
cuacuugagcaauuacuaa

SEQ ID NO: 1590672 - RNA, 19 nt, Homo sapiens
agaagaagaggaagaggaa

SEQ ID NO: 1590673 - RNA, 19 nt, Homo sapiens
agaagaagaggaagaggaa

SEQ ID NO: 1590674 - RNA, 19 nt, Homo sapiens
agaaacagaagaagaggaa

SEQ ID NO: 1590675 - RNA, 19 nt, Homo sapiens
gaaguaauaguaguagaag

SEQ ID NO: 1590676 - RNA, 19 nt, Homo sapiens
gaagcagaaagaugaugaa

SEQ ID NO: 1590677 - RNA, 19 nt, Homo sapiens
guuggaagcucaaguuacg

SEQ ID NO: 1590678 - RNA, 19 nt, Homo sapiens
aaacagaagaagaggaaga

SEQ ID NO: 1590679 - RNA, 19 nt, Homo sapiens
agaagaaggagaagaagga

SEQ ID NO: 1590680 - RNA, 19 nt, Homo sapiens
agaaggagaagaagaagga

SEQ ID NO: 1590681 - RNA, 19 nt, Homo sapiens
gggauugcacaguuaugua

SEQ ID NO: 1590682 - RNA, 19 nt, Homo sapiens
cucugucacuugucuguua

SEQ ID NO: 1590683 - RNA, 19 nt, Homo sapiens
ugucagaacucuuuuggaa

SEQ ID NO: 1590684 - RNA, 19 nt, Homo sapiens
agaugaagccgcuacuuga

SEQ ID NO: 1590685 - RNA, 19 nt, Homo sapiens
gaggaagaacaaauuaaag

SEQ ID NO: 1590686 - RNA, 19 nt, Homo sapiens
agaggaagaggaagaagaa

SEQ ID NO: 1590687 - RNA, 19 nt, Homo sapiens
agaaagaagaggaggaaga

SEQ ID NO: 1590688 - RNA, 19 nt, Homo sapiens
gaaacaagggaggaagaug

SEQ ID NO: 1590689 - RNA, 19 nt, Homo sapiens
ucgcagagaagcagaaaga

SEQ ID NO: 1590690 - RNA, 19 nt, Homo sapiens
gauacgagcacaacuugag

SEQ ID NO: 1590691 - RNA, 19 nt, Homo sapiens
aagaagaggaggaagaaga

SEQ ID NO: 1590692 - RNA, 19 nt, Homo sapiens
gaaaggaacugaaagagau

SEQ ID NO: 1590693 - RNA, 19 nt, Homo sapiens
ucacaaagcugcagcaaga

SEQ ID NO: 1590694 - RNA, 19 nt, Homo sapiens
gcagaaacgugauuauaga

SEQ ID NO: 1590695 - RNA, 19 nt, Homo sapiens
ccaaggagcuagaagauau

SEQ ID NO: 1590696 - RNA, 19 nt, Homo sapiens
gcagaaagaugaggaagga

SEQ ID NO: 1590697 - RNA, 19 nt, Homo sapiens
ucuaugaucuguugaauga

SEQ ID NO: 1590698 - RNA, 19 nt, Homo sapiens
gaaaggauccaguaaguca

SEQ ID NO: 1590699 - RNA, 19 nt, Homo sapiens
caaaagaacuugaaccuau

SEQ ID NO: 1590700 - RNA, 19 nt, Homo sapiens
gcaacaagaugggaaagga

SEQ ID NO: 1590701 - RNA, 19 nt, Homo sapiens
aaauggagcuugcaggaaa

SEQ ID NO: 1590702 - RNA, 19 nt, Homo sapiens
gcaauugcacaguuacaua

SEQ ID NO: 1590703 - RNA, 19 nt, Homo sapiens
gaacuugaaccuauguuau

SEQ ID NO: 1590704 - RNA, 19 nt, Homo sapiens
ggagggagauguaacugau

SEQ ID NO: 1590705 - RNA, 19 nt, Homo sapiens
cagcaagaguuggcacuua

SEQ ID NO: 1590706 - RNA, 19 nt, Homo sapiens
ggaaaggaacugaaagaga

SEQ ID NO: 1590707 - RNA, 19 nt, Homo sapiens
cagaugagcagaaagauga

SEQ ID NO: 1590708 - RNA, 19 nt, Homo sapiens
ggaaagcacgggcauggaa

SEQ ID NO: 1590709 - RNA, 19 nt, Homo sapiens
acaugacaguguuuaguua

SEQ ID NO: 1590710 - RNA, 19 nt, Homo sapiens
cgaauguccuugaagaguu

SEQ ID NO: 1590711 - RNA, 19 nt, Homo sapiens
ggaaggagauggagaaaag

SEQ ID NO: 1590712 - RNA, 19 nt, Homo sapiens
uauugcagcugacauuaaa

SEQ ID NO: 1590713 - RNA, 19 nt, Homo sapiens
gcacgggcauggaaaagua

SEQ ID NO: 1590714 - RNA, 19 nt, Homo sapiens
gaauguccuugaagaguuc

SEQ ID NO: 1590715 - RNA, 19 nt, Homo sapiens
gaaugaacccuagacaguu

SEQ ID NO: 1590716 - RNA, 19 nt, Homo sapiens
caaaagagguggcaacaag

SEQ ID NO: 1590717 - RNA, 19 nt, Homo sapiens
gacaaaggagggagaugua

SEQ ID NO: 1590718 - RNA, 19 nt, Homo sapiens
gaaagcacgggcauggaaa

SEQ ID NO: 1590719 - RNA, 19 nt, Homo sapiens
gcaggaaaggauccaguaa

SEQ ID NO: 1590720 - RNA, 19 nt, Homo sapiens
gauauugcagcugacauua

SEQ ID NO: 1590721 - RNA, 19 nt, Homo sapiens
ucacagaugagcagaaaga

SEQ ID NO: 1590722 - RNA, 19 nt, Homo sapiens
gagcuacacuaaaccacau

SEQ ID NO: 1590723 - RNA, 19 nt, Homo sapiens
gacaguguuuaguuaauuc

SEQ ID NO: 1590724 - RNA, 19 nt, Homo sapiens
uaacuugagcuacacuaaa

SEQ ID NO: 1590725 - RNA, 19 nt, Homo sapiens
gaaauggagcuugcaggaa

SEQ ID NO: 1590726 - RNA, 19 nt, Homo sapiens
uaaaccacaugacaguguu

SEQ ID NO: 1590727 - RNA, 19 nt, Homo sapiens
gaugggaaaggaacugaaa

SEQ ID NO: 1590728 - RNA, 19 nt, Homo sapiens
aagcagcaauugcacaguu

SEQ ID NO: 1590729 - RNA, 19 nt, Homo sapiens
ugaaugaacccuagacagu

SEQ ID NO: 1590730 - RNA, 19 nt, Homo sapiens
ccagaccacguuucuauga

SEQ ID NO: 1590731 - RNA, 19 nt, Homo sapiens
gagaacaacacaacuaaaa

SEQ ID NO: 1590732 - RNA, 19 nt, Homo sapiens
gcaagaguuggcacuuauu

SEQ ID NO: 1590733 - RNA, 19 nt, Homo sapiens
ggcagaaacgugauuauag

SEQ ID NO: 1590734 - RNA, 19 nt, Homo sapiens
gaaagaugaggaaggagau

SEQ ID NO: 1590735 - RNA, 19 nt, Homo sapiens
gaggaaagaaaaccuguua

SEQ ID NO: 1590736 - RNA, 19 nt, Homo sapiens
ucucugaaguugccgaaug

SEQ ID NO: 1590737 - RNA, 19 nt, Homo sapiens
aggaaaggauccaguaagu

SEQ ID NO: 1590738 - RNA, 19 nt, Homo sapiens
acaguuacauacacaguca

SEQ ID NO: 1590739 - RNA, 19 nt, Homo sapiens
caacaagaugggaaaggaa

SEQ ID NO: 1590740 - RNA, 19 nt, Homo sapiens
ugagaaagcagcaauugca

SEQ ID NO: 1590741 - RNA, 19 nt, Homo sapiens
gcagcgaaauaaagaacag

SEQ ID NO: 1590742 - RNA, 19 nt, Homo sapiens
gaaguugccgaauguccuu

SEQ ID NO: 1590743 - RNA, 19 nt, Homo sapiens
ccaguuggagguucaaguu

SEQ ID NO: 1590744 - RNA, 19 nt, Homo sapiens
guuggagguucaaguuaug

SEQ ID NO: 1590745 - RNA, 19 nt, Homo sapiens
agggagauguaacugauga

SEQ ID NO: 1590746 - RNA, 19 nt, Homo sapiens
caugacaguguuuaguuaa

SEQ ID NO: 1590747 - RNA, 19 nt, Homo sapiens
agaacuugaaccuauguua

SEQ ID NO: 1590748 - RNA, 19 nt, Homo sapiens
gcacuuauucagauguauc

SEQ ID NO: 1590749 - RNA, 19 nt, Homo sapiens
agauguaacugaugagcau

SEQ ID NO: 1590750 - RNA, 19 nt, Homo sapiens
augcauaacuugagcuaca

SEQ ID NO: 1590751 - RNA, 19 nt, Homo sapiens
caagaguuggcacuuauuc

SEQ ID NO: 1590752 - RNA, 19 nt, Homo sapiens
caaagcugcagcaagaguu

SEQ ID NO: 1590753 - RNA, 19 nt, Homo sapiens
gaagauauugcagcugaca

SEQ ID NO: 1590754 - RNA, 19 nt, Homo sapiens
cuguggaucuguaucaguu

SEQ ID NO: 1590755 - RNA, 19 nt, Homo sapiens
agcagcaauugcacaguua

SEQ ID NO: 1590756 - RNA, 19 nt, Homo sapiens
uggcacuuauucagaugua

SEQ ID NO: 1590757 - RNA, 19 nt, Homo sapiens
ugaggaaggagauggagaa

SEQ ID NO: 1590758 - RNA, 19 nt, Homo sapiens
cagaaacgugauuauagaa

SEQ ID NO: 1590759 - RNA, 19 nt, Homo sapiens
gaaaagauugcaaaagcuu

SEQ ID NO: 1590760 - RNA, 19 nt, Homo sapiens
uuaaaugccagaccacguu

SEQ ID NO: 1590761 - RNA, 19 nt, Homo sapiens
agcaagaguuggcacuuau

SEQ ID NO: 1590762 - RNA, 19 nt, Homo sapiens
ugccgaauguccuugaaga

SEQ ID NO: 1590763 - RNA, 19 nt, Homo sapiens
aggcagaaacgugauuaua

SEQ ID NO: 1590764 - RNA, 19 nt, Homo sapiens
ggagcuagaagauauugca

SEQ ID NO: 1590765 - RNA, 19 nt, Homo sapiens
gcacaguuacauacacagu

SEQ ID NO: 1590766 - RNA, 19 nt, Homo sapiens
uaugaucuguugaaugaac

SEQ ID NO: 1590767 - RNA, 19 nt, Homo sapiens
ccacguuucuaugaucugu

SEQ ID NO: 1590768 - RNA, 19 nt, Homo sapiens
gaccacguuucuaugaucu

SEQ ID NO: 1590769 - RNA, 19 nt, Homo sapiens
cacaugacaguguuuaguu

SEQ ID NO: 1590770 - RNA, 19 nt, Homo sapiens
uaaaugccagaccacguuu

SEQ ID NO: 1590771 - RNA, 19 nt, Homo sapiens
ggaaaggauccaguaaguc

SEQ ID NO: 1590772 - RNA, 19 nt, Homo sapiens
aaaggcagaaacgugauua

SEQ ID NO: 1590773 - RNA, 19 nt, Homo sapiens
caaggagcuagaagauauu

SEQ ID NO: 1590774 - RNA, 19 nt, Homo sapiens
agaccacguuucuaugauc

SEQ ID NO: 1590775 - RNA, 19 nt, Homo sapiens
ugagaacaacacaacuaaa

SEQ ID NO: 1590776 - RNA, 19 nt, Homo sapiens
cagaccacguuucuaugau

SEQ ID NO: 1590777 - RNA, 19 nt, Homo sapiens
caguuggagguucaaguua

SEQ ID NO: 1590778 - RNA, 19 nt, Homo sapiens
gaguuggcacuuauucaga

SEQ ID NO: 1590779 - RNA, 19 nt, Homo sapiens
aguuggagguucaaguuau

SEQ ID NO: 1590780 - RNA, 19 nt, Homo sapiens
cacacgagcaauucacaaa

SEQ ID NO: 1590781 - RNA, 19 nt, Homo sapiens
ggaaagaaaaccuguuaca

SEQ ID NO: 1590782 - RNA, 19 nt, Homo sapiens
gcuugcagcgaaauaaaga

SEQ ID NO: 1590783 - RNA, 19 nt, Homo sapiens
acaaaggagggagauguaa

SEQ ID NO: 1590784 - RNA, 19 nt, Homo sapiens
ggaucuguaucaguuccaa

SEQ ID NO: 1590785 - RNA, 19 nt, Homo sapiens
cuaaaccacaugacagugu

SEQ ID NO: 1590786 - RNA, 19 nt, Homo sapiens
gaggaaggagauggagaaa

SEQ ID NO: 1590787 - RNA, 19 nt, Homo sapiens
gcgaaauaaagaacagaau

SEQ ID NO: 1590788 - RNA, 19 nt, Homo sapiens
caauugcacaguuacauac

SEQ ID NO: 1590789 - RNA, 19 nt, Homo sapiens
ugccagaccacguuucuau

SEQ ID NO: 1590790 - RNA, 19 nt, Homo sapiens
ccacaugacaguguuuagu

SEQ ID NO: 1590791 - RNA, 19 nt, Homo sapiens
uaucuucaaccucuguuau

SEQ ID NO: 1590792 - RNA, 19 nt, Homo sapiens
ugaaauaccugcaaaguag

SEQ ID NO: 1590793 - RNA, 19 nt, Homo sapiens
gaaccaauauauacaaugg

SEQ ID NO: 1590794 - RNA, 19 nt, Homo sapiens
aagaacaucuccagaggaa

SEQ ID NO: 1590795 - RNA, 19 nt, Homo sapiens
gaacaucuccagaggaacu

SEQ ID NO: 1590796 - RNA, 19 nt, Homo sapiens
uugaaauaccugcaaagua

SEQ ID NO: 1590797 - RNA, 19 nt, Homo sapiens
aaauggaggaggaggaauu

SEQ ID NO: 1590798 - RNA, 19 nt, Homo sapiens
ccaaauggaggaggaggaa

SEQ ID NO: 1590799 - RNA, 19 nt, Homo sapiens
caagaagcuacaucucuca

SEQ ID NO: 1590800 - RNA, 19 nt, Homo sapiens
gccugccgcugacauugaa

SEQ ID NO: 1590801 - RNA, 19 nt, Homo sapiens
cccgcaaccugcuccgaaa

SEQ ID NO: 1590802 - RNA, 19 nt, Homo sapiens
guugaaauaccugcaaagu

SEQ ID NO: 1590803 - RNA, 19 nt, Homo sapiens
uaaaguuugagaagcugaa

SEQ ID NO: 1590804 - RNA, 19 nt, Homo sapiens
ugguugaaauaccugcaaa

SEQ ID NO: 1590805 - RNA, 19 nt, Homo sapiens
gaaaagaucuugcuaaagu

SEQ ID NO: 1590806 - RNA, 19 nt, Homo sapiens
gcacuacuuugaaaucgua

SEQ ID NO: 1590807 - RNA, 19 nt, Homo sapiens
ggauauauuucuacucuug

SEQ ID NO: 1590808 - RNA, 19 nt, Homo sapiens
ggaagcagauguccugguu

SEQ ID NO: 1590809 - RNA, 19 nt, Homo sapiens
gacaaaaggugguuaagua

SEQ ID NO: 1590810 - RNA, 19 nt, Homo sapiens
gagacgaauuguuguuaaa

SEQ ID NO: 1590811 - RNA, 19 nt, Homo sapiens
gcacauugcauuaaguuau

SEQ ID NO: 1590812 - RNA, 19 nt, Homo sapiens
uaaccaaccuuauaaagac

SEQ ID NO: 1590813 - RNA, 19 nt, Homo sapiens
guagucauuuguacuuuga

SEQ ID NO: 1590814 - RNA, 19 nt, Homo sapiens
cuacgaaguuggaaugaga

SEQ ID NO: 1590815 - RNA, 19 nt, Homo sapiens
gagggucacuauuaacaau

SEQ ID NO: 1590816 - RNA, 19 nt, Homo sapiens
ccagaaaacuuuggugaua

SEQ ID NO: 1590817 - RNA, 19 nt, Homo sapiens
ugagacgaauuguuguuaa

SEQ ID NO: 1590818 - RNA, 19 nt, Homo sapiens
ucuaacagcuuuugcuuua

SEQ ID NO: 1590819 - RNA, 19 nt, Homo sapiens
gagggaagauauuuuauug

SEQ ID NO: 1590820 - RNA, 19 nt, Homo sapiens
cauccugacucauguguug

SEQ ID NO: 1590821 - RNA, 19 nt, Homo sapiens
ggugauaauucuugagaca

SEQ ID NO: 1590822 - RNA, 19 nt, Homo sapiens
ugacucauguguuguguuc

SEQ ID NO: 1590823 - RNA, 19 nt, Homo sapiens
gauauugcacuacuuugaa

SEQ ID NO: 1590824 - RNA, 19 nt, Homo sapiens
auauacaucugccuggaua

SEQ ID NO: 1590825 - RNA, 19 nt, Homo sapiens
gcauuaaguuaugaugaga

SEQ ID NO: 1590826 - RNA, 19 nt, Homo sapiens
ggaagacccacccuacgaa

SEQ ID NO: 1590827 - RNA, 19 nt, Homo sapiens
gugguuaaguagcauuauu

SEQ ID NO: 1590828 - RNA, 19 nt, Homo sapiens
gagcggacgguguucaauu

SEQ ID NO: 1590829 - RNA, 19 nt, Homo sapiens
cuuugugacuguuucaaua

SEQ ID NO: 1590830 - RNA, 19 nt, Homo sapiens
ucaauuccaugcugguuuc

SEQ ID NO: 1590831 - RNA, 19 nt, Homo sapiens
cacauugcauuaaguuaug

SEQ ID NO: 1590832 - RNA, 19 nt, Homo sapiens
uaguugggcuuuacuguuc

SEQ ID NO: 1590833 - RNA, 19 nt, Homo sapiens
guuaugaugagacgaauug

SEQ ID NO: 1590834 - RNA, 19 nt, Homo sapiens
gcuuauauaccauagaguu

SEQ ID NO: 1590835 - RNA, 19 nt, Homo sapiens
ggacgguguucaauuccau

SEQ ID NO: 1590836 - RNA, 19 nt, Homo sapiens
uuacuguucuugcuauugu

SEQ ID NO: 1590837 - RNA, 19 nt, Homo sapiens
gcacaucauggcgauauug

SEQ ID NO: 1590838 - RNA, 19 nt, Homo sapiens
uaaguuaugaugagacgaa

SEQ ID NO: 1590839 - RNA, 19 nt, Homo sapiens
aaucauuaguugggcuuua

SEQ ID NO: 1590840 - RNA, 19 nt, Homo sapiens
gaaaucguacaaugaccaa

SEQ ID NO: 1590841 - RNA, 19 nt, Homo sapiens
ggucacuauuaacaaugua

SEQ ID NO: 1590842 - RNA, 19 nt, Homo sapiens
cuccgagggucacuauuaa

SEQ ID NO: 1590843 - RNA, 19 nt, Homo sapiens
ggaaaaucauccugacuca

SEQ ID NO: 1590844 - RNA, 19 nt, Homo sapiens
cgauauugcacuacuuuga

SEQ ID NO: 1590845 - RNA, 19 nt, Homo sapiens
gaugagacgaauuguuguu

SEQ ID NO: 1590846 - RNA, 19 nt, Homo sapiens
gcuuuacuguucuugcuau

SEQ ID NO: 1590847 - RNA, 19 nt, Homo sapiens
gaaguuggaaugagaccau

SEQ ID NO: 1590848 - RNA, 19 nt, Homo sapiens
gggaagacccacccuacga

SEQ ID NO: 1590849 - RNA, 19 nt, Homo sapiens
ucacggcgcucuacaugcu

SEQ ID NO: 1590850 - RNA, 19 nt, Homo sapiens
acaucugccuggauauauu

SEQ ID NO: 1590851 - RNA, 19 nt, Homo sapiens
cauguguuguguucuuuau

SEQ ID NO: 1590852 - RNA, 19 nt, Homo sapiens
ccaaccuuauaaagacuaa

SEQ ID NO: 1590853 - RNA, 19 nt, Homo sapiens
ucauggcgauauugcacua

SEQ ID NO: 1590854 - RNA, 19 nt, Homo sapiens
gcagauguccugguucuac

SEQ ID NO: 1590855 - RNA, 19 nt, Homo sapiens
ggaguacaguuuuagcuau

SEQ ID NO: 1590856 - RNA, 19 nt, Homo sapiens
gucaacauaaccaaccuua

SEQ ID NO: 1590857 - RNA, 19 nt, Homo sapiens
ggucacggcgcucuacaug

SEQ ID NO: 1590858 - RNA, 19 nt, Homo sapiens
caucugccuggauauauuu

SEQ ID NO: 1590859 - RNA, 19 nt, Homo sapiens
gggucacuauuaacaaugu

SEQ ID NO: 1590860 - RNA, 19 nt, Homo sapiens
cagaaaacuuuggugauaa

SEQ ID NO: 1590861 - RNA, 19 nt, Homo sapiens
cuggauauauuucuacucu

SEQ ID NO: 1590862 - RNA, 19 nt, Homo sapiens
uaaccuuugugacuguuuc

SEQ ID NO: 1590863 - RNA, 19 nt, Homo sapiens
gagaacuacuuaacaaaag

SEQ ID NO: 1590864 - RNA, 19 nt, Homo sapiens
gggaagauauuuuauugag

SEQ ID NO: 1590865 - RNA, 19 nt, Homo sapiens
ggcgauauugcacuacuuu

SEQ ID NO: 1590866 - RNA, 19 nt, Homo sapiens
aagcagauguccugguucu

SEQ ID NO: 1590867 - RNA, 19 nt, Homo sapiens
gaaacucuucuagauguca

SEQ ID NO: 1590868 - RNA, 19 nt, Homo sapiens
caagaugcgaccaggauca

SEQ ID NO: 1590869 - RNA, 19 nt, Homo sapiens
uguagucauuuguacuuug

SEQ ID NO: 1590870 - RNA, 19 nt, Homo sapiens
acucauguguuguguucuu

SEQ ID NO: 1590871 - RNA, 19 nt, Homo sapiens
ggggagggaagauauuuua

SEQ ID NO: 1590872 - RNA, 19 nt, Homo sapiens
ggagggaagauauuuuauu

SEQ ID NO: 1590873 - RNA, 19 nt, Homo sapiens
auacaucugccuggauaua

SEQ ID NO: 1590874 - RNA, 19 nt, Homo sapiens
gacccacccuacgaaguug

SEQ ID NO: 1590875 - RNA, 19 nt, Homo sapiens
agacccacccuacgaaguu

SEQ ID NO: 1590876 - RNA, 19 nt, Homo sapiens
augaugagacgaauuguug

SEQ ID NO: 1590877 - RNA, 19 nt, Homo sapiens
cacaggauacgucuucaug

SEQ ID NO: 1590878 - RNA, 19 nt, Homo sapiens
uuucuacucuugaccaaag

SEQ ID NO: 1590879 - RNA, 19 nt, Homo sapiens
aggaacauuucaccuuuua

SEQ ID NO: 1590880 - RNA, 19 nt, Homo sapiens
cagcacaucauggcgauau

SEQ ID NO: 1590881 - RNA, 19 nt, Homo sapiens
acuuugaaaucguacaaug

SEQ ID NO: 1590882 - RNA, 19 nt, Homo sapiens
gggcuuuacuguucuugcu

SEQ ID NO: 1590883 - RNA, 19 nt, Homo sapiens
aaacucuucuagaugucaa

SEQ ID NO: 1590884 - RNA, 19 nt, Homo sapiens
cugccuggauauauuucua

SEQ ID NO: 1590885 - RNA, 19 nt, Homo sapiens
gcucuuguauagcaguuuu

SEQ ID NO: 1590886 - RNA, 19 nt, Homo sapiens
aaaucauccugacucaugu

SEQ ID NO: 1590887 - RNA, 19 nt, Homo sapiens
gaguagaacaggaaaauca

SEQ ID NO: 1590888 - RNA, 19 nt, Homo sapiens
auacacaggauacgucuuc

SEQ ID NO: 1590889 - RNA, 19 nt, Homo sapiens
ugcauuaaguuaugaugag

SEQ ID NO: 1590890 - RNA, 19 nt, Homo sapiens
uccuuucacucuuuguauu

SEQ ID NO: 1590891 - RNA, 19 nt, Homo sapiens
aaucguacaaugaccaaga

SEQ ID NO: 1590892 - RNA, 19 nt, Homo sapiens
caugcugguuuccauugug

SEQ ID NO: 1590893 - RNA, 19 nt, Homo sapiens
ccaugcugguuuccauugu

SEQ ID NO: 1590894 - RNA, 19 nt, Homo sapiens
gugacuguuucaauauuac

SEQ ID NO: 1590895 - RNA, 19 nt, Homo sapiens
ucauguguuguguucuuua

SEQ ID NO: 1590896 - RNA, 19 nt, Homo sapiens
cgagggucacuauuaacaa

SEQ ID NO: 1590897 - RNA, 19 nt, Homo sapiens
ggucuuaccucagcaguua

SEQ ID NO: 1590898 - RNA, 19 nt, Homo sapiens
gcagaugacugagaacauu

SEQ ID NO: 1590899 - RNA, 19 nt, Homo sapiens
guacauggcugcuacuucu

SEQ ID NO: 1590900 - RNA, 19 nt, Homo sapiens
gggagcagaugacugagaa

SEQ ID NO: 1590901 - RNA, 19 nt, Homo sapiens
guacacagcccaugcaucu

SEQ ID NO: 1590902 - RNA, 19 nt, Homo sapiens
gcacacccuuuccuucucu

SEQ ID NO: 1590903 - RNA, 19 nt, Homo sapiens
gcauuuagggagcagauga

SEQ ID NO: 1590904 - RNA, 19 nt, Homo sapiens
gcuccuuccuccagucuug

SEQ ID NO: 1590905 - RNA, 19 nt, Homo sapiens
gagggucacagcaggagua

SEQ ID NO: 1590906 - RNA, 19 nt, Homo sapiens
cagaugacugagaacauua

SEQ ID NO: 1590907 - RNA, 19 nt, Homo sapiens
uuagggagcagaugacuga

SEQ ID NO: 1590908 - RNA, 19 nt, Homo sapiens
gauggcaccuggaccaacu

SEQ ID NO: 1590909 - RNA, 19 nt, Homo sapiens
gagcagaugacugagaaca

SEQ ID NO: 1590910 - RNA, 19 nt, Homo sapiens
cuggaugccuucaccuaug

SEQ ID NO: 1590911 - RNA, 19 nt, Homo sapiens
gaugacugagaacauuaaa

SEQ ID NO: 1590912 - RNA, 19 nt, Homo sapiens
ucuucaagcugcugcuguu

SEQ ID NO: 1590913 - RNA, 19 nt, Homo sapiens
ggaguacacagcccaugca

SEQ ID NO: 1590914 - RNA, 19 nt, Homo sapiens
ggucacagcaggaguacac

SEQ ID NO: 1590915 - RNA, 19 nt, Homo sapiens
gugaggagcugccaaagaa

SEQ ID NO: 1590916 - RNA, 19 nt, Homo sapiens
gcauuugucuguuugauau

SEQ ID NO: 1590917 - RNA, 19 nt, Homo sapiens
ccgaggagcugaacaagaa

SEQ ID NO: 1590918 - RNA, 19 nt, Homo sapiens
ccaacaaggucguguacaa

SEQ ID NO: 1590919 - RNA, 19 nt, Homo sapiens
gacgagagcuuuguugaca

SEQ ID NO: 1590920 - RNA, 19 nt, Homo sapiens
ggaggaugccuauguauuc

SEQ ID NO: 1590921 - RNA, 19 nt, Homo sapiens
cagcugaggccgaugcuaa

SEQ ID NO: 1590922 - RNA, 19 nt, Homo sapiens
caacgugggacucugcauu

SEQ ID NO: 1590923 - RNA, 19 nt, Homo sapiens
gaagcucaacgacuccauu

SEQ ID NO: 1590924 - RNA, 19 nt, Homo sapiens
ggccgaugcuaaggagaua

SEQ ID NO: 1590925 - RNA, 19 nt, Homo sapiens
gguguuucauccauuccua

SEQ ID NO: 1590926 - RNA, 19 nt, Homo sapiens
cagcagaugccaccacuuc

SEQ ID NO: 1590927 - RNA, 19 nt, Homo sapiens
cacacgaccucuacaugga

SEQ ID NO: 1590928 - RNA, 19 nt, Homo sapiens
ggagugcacgucucucuag

SEQ ID NO: 1590929 - RNA, 19 nt, Homo sapiens
ggacucugcauuugucugu

SEQ ID NO: 1590930 - RNA, 19 nt, Homo sapiens
gcgcaucacacaccaaagu

SEQ ID NO: 1590931 - RNA, 19 nt, Homo sapiens
gucucgagcuggacaguga

SEQ ID NO: 1590932 - RNA, 19 nt, Homo sapiens
acuggaggaugccuaugua

SEQ ID NO: 1590933 - RNA, 19 nt, Homo sapiens
acucugcauuugucuguuu

SEQ ID NO: 1590934 - RNA, 19 nt, Homo sapiens
ccagugaggagcugccaaa

SEQ ID NO: 1590935 - RNA, 19 nt, Homo sapiens
caaacuggaggaugccuau

SEQ ID NO: 1590936 - RNA, 19 nt, Homo sapiens
gugggacucugcauuuguc

SEQ ID NO: 1590937 - RNA, 19 nt, Homo sapiens
gagcacacgaccucuacau

SEQ ID NO: 1590938 - RNA, 19 nt, Homo sapiens
gcagcagccagccaaguuc

SEQ ID NO: 1590939 - RNA, 19 nt, Homo sapiens
gcagaugccaccacuucca

SEQ ID NO: 1590940 - RNA, 19 nt, Homo sapiens
ggacgagagcuuuguugac

SEQ ID NO: 1590941 - RNA, 19 nt, Homo sapiens
guacgagacggaggaagga

SEQ ID NO: 1590942 - RNA, 19 nt, Homo sapiens
uggaggaugccuauguauu

SEQ ID NO: 1590943 - RNA, 19 nt, Homo sapiens
gcgugguguuucauccauu

SEQ ID NO: 1590944 - RNA, 19 nt, Homo sapiens
ggugguggacgagagcuuu

SEQ ID NO: 1590945 - RNA, 19 nt, Homo sapiens
gaggaugccuauguauucc

SEQ ID NO: 1590946 - RNA, 19 nt, Homo sapiens
caacaaggucguguacaac

SEQ ID NO: 1590947 - RNA, 19 nt, Homo sapiens
cgugguguuucauccauuc

SEQ ID NO: 1590948 - RNA, 19 nt, Homo sapiens
cuuggcaguuugagaggaa

SEQ ID NO: 1590949 - RNA, 19 nt, Homo sapiens
gaggacagcuggcuaaaug

SEQ ID NO: 1590950 - RNA, 19 nt, Homo sapiens
gaaaugggacucaagaauu

SEQ ID NO: 1590951 - RNA, 19 nt, Homo sapiens
gagaguggcuaguagauga

SEQ ID NO: 1590952 - RNA, 19 nt, Homo sapiens
ucacaaacagcacaaauua

SEQ ID NO: 1590953 - RNA, 19 nt, Homo sapiens
gaacaccaauucuuuacau

SEQ ID NO: 1590954 - RNA, 19 nt, Homo sapiens
ccaauaaagccuccuguua

SEQ ID NO: 1590955 - RNA, 19 nt, Homo sapiens
gcauaugggugaauguuug

SEQ ID NO: 1590956 - RNA, 19 nt, Homo sapiens
gcauaugggugaauguuug

SEQ ID NO: 1590957 - RNA, 19 nt, Homo sapiens
gcauaugggugaauguuug

SEQ ID NO: 1590958 - RNA, 19 nt, Homo sapiens
caaagugaccugcaaauga

SEQ ID NO: 1590959 - RNA, 19 nt, Homo sapiens
gaauaggccagauuuaauu

SEQ ID NO: 1590960 - RNA, 19 nt, Homo sapiens
gcaaaugauuggcuucugu

SEQ ID NO: 1590961 - RNA, 19 nt, Homo sapiens
gcauagaucucuccuucug

SEQ ID NO: 1590962 - RNA, 19 nt, Homo sapiens
gaaccaucccuucccuuua

SEQ ID NO: 1590963 - RNA, 19 nt, Homo sapiens
gaucucuccuucugccaua

SEQ ID NO: 1590964 - RNA, 19 nt, Homo sapiens
gcauacgggugaauguuug

SEQ ID NO: 1590965 - RNA, 19 nt, Homo sapiens
aaagugaccugcaaaugau

SEQ ID NO: 1590966 - RNA, 19 nt, Homo sapiens
gcacugaacaccaauucuu

SEQ ID NO: 1590967 - RNA, 19 nt, Homo sapiens
cagaauaggccagauuuaa

SEQ ID NO: 1590968 - RNA, 19 nt, Homo sapiens
ggacaucuguguguuugug

SEQ ID NO: 1590969 - RNA, 19 nt, Homo sapiens
gcacacaucaagaauacuu

SEQ ID NO: 1590970 - RNA, 19 nt, Homo sapiens
gaacucacaccaaccauag

SEQ ID NO: 1590971 - RNA, 19 nt, Homo sapiens
gaucaaauccugccaucug

SEQ ID NO: 1590972 - RNA, 19 nt, Homo sapiens
gcccaugaguauaugcaua

SEQ ID NO: 1590973 - RNA, 19 nt, Homo sapiens
gcccaugaguauaugcaua

SEQ ID NO: 1590974 - RNA, 19 nt, Homo sapiens
ggaacucacaccaaccaua

SEQ ID NO: 1590975 - RNA, 19 nt, Homo sapiens
uaaagccuccuguuauaaa

SEQ ID NO: 1590976 - RNA, 19 nt, Homo sapiens
ggacaaagugaccugcaaa

SEQ ID NO: 1590977 - RNA, 19 nt, Homo sapiens
aagcugaaauuguuccaaa

SEQ ID NO: 1590978 - RNA, 19 nt, Homo sapiens
gcuaaaugcuauccucagu

SEQ ID NO: 1590979 - RNA, 19 nt, Homo sapiens
ggagugaaugugcccauaa

SEQ ID NO: 1590980 - RNA, 19 nt, Homo sapiens
caaaugauuggcuucugua

SEQ ID NO: 1590981 - RNA, 19 nt, Homo sapiens
caauauuaccuucugugua

SEQ ID NO: 1590982 - RNA, 19 nt, Homo sapiens
gcaaucccuuaaugucaga

SEQ ID NO: 1590983 - RNA, 19 nt, Homo sapiens
ggaaaccaggauuuagaaa

SEQ ID NO: 1590984 - RNA, 19 nt, Homo sapiens
gugauucuguccaauaaag

SEQ ID NO: 1590985 - RNA, 19 nt, Homo sapiens
guaauccacuugccaacag

SEQ ID NO: 1590986 - RNA, 19 nt, Homo sapiens
gggacaaagugaccugcaa

SEQ ID NO: 1590987 - RNA, 19 nt, Homo sapiens
guaaugagggcacugaaca

SEQ ID NO: 1590988 - RNA, 19 nt, Homo sapiens
cuugcaagcugaaauuguu

SEQ ID NO: 1590989 - RNA, 19 nt, Homo sapiens
gcaauauuaccuucugugu

SEQ ID NO: 1590990 - RNA, 19 nt, Homo sapiens
gauagaagggaguccaguu

SEQ ID NO: 1590991 - RNA, 19 nt, Homo sapiens
ugagggcacugaacaccaa

SEQ ID NO: 1590992 - RNA, 19 nt, Homo sapiens
ucauggaacacacucauuu

SEQ ID NO: 1590993 - RNA, 19 nt, Homo sapiens
ccagaauaggccagauuua

SEQ ID NO: 1590994 - RNA, 19 nt, Homo sapiens
gaacacaaacagcuacacu

SEQ ID NO: 1590995 - RNA, 19 nt, Homo sapiens
guaugugccagcugguuua

SEQ ID NO: 1590996 - RNA, 19 nt, Homo sapiens
gaucacaaacagcacaaau

SEQ ID NO: 1590997 - RNA, 19 nt, Homo sapiens
ugaaaugggacucaagaau

SEQ ID NO: 1590998 - RNA, 19 nt, Homo sapiens
accagaagcccucccaaua

SEQ ID NO: 1590999 - RNA, 19 nt, Homo sapiens
gaaaaugggugggacaucu

SEQ ID NO: 1591000 - RNA, 19 nt, Homo sapiens
augauuggcuucuguacaa

SEQ ID NO: 1591001 - RNA, 19 nt, Homo sapiens
auagaagggaguccaguua

SEQ ID NO: 1591002 - RNA, 19 nt, Homo sapiens
gcuuuacucugcccagugu

SEQ ID NO: 1591003 - RNA, 19 nt, Homo sapiens
aaugcugccugcucuguuu

SEQ ID NO: 1591004 - RNA, 19 nt, Homo sapiens
uagaagggaguccaguuaa

SEQ ID NO: 1591005 - RNA, 19 nt, Homo sapiens
ccaauucuuuacauuccuu

SEQ ID NO: 1591006 - RNA, 19 nt, Homo sapiens
gaugguuaauacagggaaa

SEQ ID NO: 1591007 - RNA, 19 nt, Homo sapiens
ccagaagcccucccaauac

SEQ ID NO: 1591008 - RNA, 19 nt, Homo sapiens
ggcuaacucuggaucacaa

SEQ ID NO: 1591009 - RNA, 19 nt, Homo sapiens
gcccgugauuauaugcaua

SEQ ID NO: 1591010 - RNA, 19 nt, Homo sapiens
gguuuagcauucaauaugg

SEQ ID NO: 1591011 - RNA, 19 nt, Homo sapiens
aaccaucccuucccuuuag

SEQ ID NO: 1591012 - RNA, 19 nt, Homo sapiens
agaauaggccagauuuaau

SEQ ID NO: 1591013 - RNA, 19 nt, Homo sapiens
cacaaacagcacaaauuaa

SEQ ID NO: 1591014 - RNA, 19 nt, Homo sapiens
ugagaggacagcuggcuaa

SEQ ID NO: 1591015 - RNA, 19 nt, Homo sapiens
gaauugaugguuaauacag

SEQ ID NO: 1591016 - RNA, 19 nt, Homo sapiens
gaaaccaggauuuagaaaa

SEQ ID NO: 1591017 - RNA, 19 nt, Homo sapiens
gguaugugccagcugguuu

SEQ ID NO: 1591018 - RNA, 19 nt, Homo sapiens
ggaguccaguuaaggaaac

SEQ ID NO: 1591019 - RNA, 19 nt, Homo sapiens
gagugaaugugcccauaac

SEQ ID NO: 1591020 - RNA, 19 nt, Homo sapiens
guaaauacaaccucuuuug

SEQ ID NO: 1591021 - RNA, 19 nt, Homo sapiens
gaagggaguccaguuaagg

SEQ ID NO: 1591022 - RNA, 19 nt, Homo sapiens
acagcuggcuaaaugcuau

SEQ ID NO: 1591023 - RNA, 19 nt, Homo sapiens
aucuggaugugcauuauua

SEQ ID NO: 1591024 - RNA, 19 nt, Homo sapiens
uguaguggaugccaguaga

SEQ ID NO: 1591025 - RNA, 19 nt, Homo sapiens
gcugguguuuggugaggaa

SEQ ID NO: 1591026 - RNA, 19 nt, Homo sapiens
cagaagcccucccaauacg

SEQ ID NO: 1591027 - RNA, 19 nt, Homo sapiens
gcccaugagcauaugcaua

SEQ ID NO: 1591028 - RNA, 19 nt, Homo sapiens
caauauggaaaugcacuuu

SEQ ID NO: 1591029 - RNA, 19 nt, Homo sapiens
acugaacaccaauucuuua

SEQ ID NO: 1591030 - RNA, 19 nt, Homo sapiens
ucccuucccuuuagugaga

SEQ ID NO: 1591031 - RNA, 19 nt, Homo sapiens
uauuaaugcugguguuugg

SEQ ID NO: 1591032 - RNA, 19 nt, Homo sapiens
agaagggaguccaguuaag

SEQ ID NO: 1591033 - RNA, 19 nt, Homo sapiens
agaaccaucccuucccuuu

SEQ ID NO: 1591034 - RNA, 19 nt, Homo sapiens
ggaugccaguagacaacuu

SEQ ID NO: 1591035 - RNA, 19 nt, Homo sapiens
ugccugcucuguuuacaau

SEQ ID NO: 1591036 - RNA, 19 nt, Homo sapiens
ggugggacaucuguguguu

SEQ ID NO: 1591037 - RNA, 19 nt, Homo sapiens
uggcuucuguacaauguug

SEQ ID NO: 1591038 - RNA, 19 nt, Homo sapiens
gaugccaguagacaacuuu

SEQ ID NO: 1591039 - RNA, 19 nt, Homo sapiens
uugugauucuguccaauaa

SEQ ID NO: 1591040 - RNA, 19 nt, Homo sapiens
gacaaagugaccugcaaau

SEQ ID NO: 1591041 - RNA, 19 nt, Homo sapiens
uugcacacaucaagaauac

SEQ ID NO: 1591042 - RNA, 19 nt, Homo sapiens
ccagagaguggcuaguaga

SEQ ID NO: 1591043 - RNA, 19 nt, Homo sapiens
gcccaugauuuuaugcaua

SEQ ID NO: 1591044 - RNA, 19 nt, Homo sapiens
caauguugcaaucccuuaa

SEQ ID NO: 1591045 - RNA, 19 nt, Homo sapiens
gcugguuuagcauucaaua

SEQ ID NO: 1591046 - RNA, 19 nt, Homo sapiens
uggagugaaugugcccaua

SEQ ID NO: 1591047 - RNA, 19 nt, Homo sapiens
ugggacaucuguguguuug

SEQ ID NO: 1591048 - RNA, 19 nt, Homo sapiens
cacugaacaccaauucuuu

SEQ ID NO: 1591049 - RNA, 19 nt, Homo sapiens
ggacaaaguucuguauaua

SEQ ID NO: 1591050 - RNA, 19 nt, Homo sapiens
gaauacaucuuguuucuga

SEQ ID NO: 1591051 - RNA, 19 nt, Homo sapiens
ucacauagaucuagucuga

SEQ ID NO: 1591052 - RNA, 19 nt, Homo sapiens
uaaaguggcugguuaauuc

SEQ ID NO: 1591053 - RNA, 19 nt, Homo sapiens
gguaaaguguuaaggaaua

SEQ ID NO: 1591054 - RNA, 19 nt, Homo sapiens
ggaccuggcuacguaauua

SEQ ID NO: 1591055 - RNA, 19 nt, Homo sapiens
uaaaugaccucagaucuuu

SEQ ID NO: 1591056 - RNA, 19 nt, Homo sapiens
gaaagaacccucaaucaga

SEQ ID NO: 1591057 - RNA, 19 nt, Homo sapiens
gagagaaggugaaauaaag

SEQ ID NO: 1591058 - RNA, 19 nt, Homo sapiens
gaaaggauuuaaagggaaa

SEQ ID NO: 1591059 - RNA, 19 nt, Homo sapiens
cggagaagcugucgaaauu

SEQ ID NO: 1591060 - RNA, 19 nt, Homo sapiens
ggagaucaguaauuacaaa

SEQ ID NO: 1591061 - RNA, 19 nt, Homo sapiens
gaaacaggauaugcuuuaa

SEQ ID NO: 1591062 - RNA, 19 nt, Homo sapiens
caagagaggugcuaucaca

SEQ ID NO: 1591063 - RNA, 19 nt, Homo sapiens
ggucagcaguggaguuuaa

SEQ ID NO: 1591064 - RNA, 19 nt, Homo sapiens
caacaucucuugagugucu

SEQ ID NO: 1591065 - RNA, 19 nt, Homo sapiens
gcaauuaagcgaacuaaau

SEQ ID NO: 1591066 - RNA, 19 nt, Homo sapiens
uaacugugcuuguugaaug

SEQ ID NO: 1591067 - RNA, 19 nt, Homo sapiens
gugaggcccuuauauaauu

SEQ ID NO: 1591068 - RNA, 19 nt, Homo sapiens
gaugcucaccucuauauua

SEQ ID NO: 1591069 - RNA, 19 nt, Homo sapiens
gcuaacaaguuugagcuua

SEQ ID NO: 1591070 - RNA, 19 nt, Homo sapiens
ggacauguacugagacaaa

SEQ ID NO: 1591071 - RNA, 19 nt, Homo sapiens
cuaaauauguccaccaaga

SEQ ID NO: 1591072 - RNA, 19 nt, Homo sapiens
gagaagcugucgaaauuca

SEQ ID NO: 1591073 - RNA, 19 nt, Homo sapiens
gggaggaccuguuguguuc

SEQ ID NO: 1591074 - RNA, 19 nt, Homo sapiens
uuaagagccuucaauugua

SEQ ID NO: 1591075 - RNA, 19 nt, Homo sapiens
gaacugaggcaucgcgaaa

SEQ ID NO: 1591076 - RNA, 19 nt, Homo sapiens
ucgaugagguuccauguuu

SEQ ID NO: 1591077 - RNA, 19 nt, Homo sapiens
cccaggagaucaguaauua

SEQ ID NO: 1591078 - RNA, 19 nt, Homo sapiens
acagagugauuguaguuua

SEQ ID NO: 1591079 - RNA, 19 nt, Homo sapiens
uauaacaccuuaacaguca

SEQ ID NO: 1591080 - RNA, 19 nt, Homo sapiens
gaauggagaauacaucuug

SEQ ID NO: 1591081 - RNA, 19 nt, Homo sapiens
uaugucaugucuuccauua

SEQ ID NO: 1591082 - RNA, 19 nt, Homo sapiens
gcucaccucuauauuaguu

SEQ ID NO: 1591083 - RNA, 19 nt, Homo sapiens
caccaagccuguuugcuaa

SEQ ID NO: 1591084 - RNA, 19 nt, Homo sapiens
ccacuaaggugaccagagu

SEQ ID NO: 1591085 - RNA, 19 nt, Homo sapiens
acacuuuccucuucuauga

SEQ ID NO: 1591086 - RNA, 19 nt, Homo sapiens
gaccugaacugucugaaag

SEQ ID NO: 1591087 - RNA, 19 nt, Homo sapiens
caaaauaggugaggggaua

SEQ ID NO: 1591088 - RNA, 19 nt, Homo sapiens
cuaacaaguuugagcuuaa

SEQ ID NO: 1591089 - RNA, 19 nt, Homo sapiens
ggaaaccucagagcuauaa

SEQ ID NO: 1591090 - RNA, 19 nt, Homo sapiens
ggagaaaggaggagacaga

SEQ ID NO: 1591091 - RNA, 19 nt, Homo sapiens
gauaguaguggcucgauuu

SEQ ID NO: 1591092 - RNA, 19 nt, Homo sapiens
gaauuagguuucuuugaag

SEQ ID NO: 1591093 - RNA, 19 nt, Homo sapiens
ggaagaagaggcugcauuc

SEQ ID NO: 1591094 - RNA, 19 nt, Homo sapiens
cagagugauuguaguuuaa

SEQ ID NO: 1591095 - RNA, 19 nt, Homo sapiens
ggauaugcuuuaagacaga

SEQ ID NO: 1591096 - RNA, 19 nt, Homo sapiens
ccagagaguuugucgacuu

SEQ ID NO: 1591097 - RNA, 19 nt, Homo sapiens
cacaucagcugaccaucua

SEQ ID NO: 1591098 - RNA, 19 nt, Homo sapiens
agaaacaggauaugcuuua

SEQ ID NO: 1591099 - RNA, 19 nt, Homo sapiens
gcuauaaaguggagugaca

SEQ ID NO: 1591100 - RNA, 19 nt, Homo sapiens
ccaaagggccauugaucua

SEQ ID NO: 1591101 - RNA, 19 nt, Homo sapiens
ucacaccgaucauuucuca

SEQ ID NO: 1591102 - RNA, 19 nt, Homo sapiens
ggucaucucuccugugucu

SEQ ID NO: 1591103 - RNA, 19 nt, Homo sapiens
ggaaguacgucaucaacac

SEQ ID NO: 1591104 - RNA, 19 nt, Homo sapiens
ggaaugcccugaaacuacu

SEQ ID NO: 1591105 - RNA, 19 nt, Homo sapiens
ccagacagauagugaaaca

SEQ ID NO: 1591106 - RNA, 19 nt, Homo sapiens
aaacauaagcuaccugaau

SEQ ID NO: 1591107 - RNA, 19 nt, Homo sapiens
uuacugaguugcuuccaaa

SEQ ID NO: 1591108 - RNA, 19 nt, Homo sapiens
cagaaucacuacaucacaa

SEQ ID NO: 1591109 - RNA, 19 nt, Homo sapiens
ugagguggauuuacugaga

SEQ ID NO: 1591110 - RNA, 19 nt, Homo sapiens
ucaccaagccuguuugcua

SEQ ID NO: 1591111 - RNA, 19 nt, Homo sapiens
agaauggucucaguguuaa

SEQ ID NO: 1591112 - RNA, 19 nt, Homo sapiens
uaagaauggucucaguguu

SEQ ID NO: 1591113 - RNA, 19 nt, Homo sapiens
gauaauacugucuaggaaa

SEQ ID NO: 1591114 - RNA, 19 nt, Homo sapiens
gagugaaacugcgauacaa

SEQ ID NO: 1591115 - RNA, 19 nt, Homo sapiens
cagagaguuugucgacuuu

SEQ ID NO: 1591116 - RNA, 19 nt, Homo sapiens
ggucauccauaaggacuuu

SEQ ID NO: 1591117 - RNA, 19 nt, Homo sapiens
gauuaaaggauucaggaaa

SEQ ID NO: 1591118 - RNA, 19 nt, Homo sapiens
aagaauggucucaguguua

SEQ ID NO: 1591119 - RNA, 19 nt, Homo sapiens
ggaagagcauaguguuugg

SEQ ID NO: 1591120 - RNA, 19 nt, Homo sapiens
gugguaaaguguuaaggaa

SEQ ID NO: 1591121 - RNA, 19 nt, Homo sapiens
ugaggcccuuauauaauua

SEQ ID NO: 1591122 - RNA, 19 nt, Homo sapiens
caacagagagggagaaagg

SEQ ID NO: 1591123 - RNA, 19 nt, Homo sapiens
ggagaaucuuacagaguga

SEQ ID NO: 1591124 - RNA, 19 nt, Homo sapiens
uaagagccuucaauuguag

SEQ ID NO: 1591125 - RNA, 19 nt, Homo sapiens
ggccauugaucuacuacaa

SEQ ID NO: 1591126 - RNA, 19 nt, Homo sapiens
uaacugaggcuuagaaagg

SEQ ID NO: 1591127 - RNA, 19 nt, Homo sapiens
aguuugagcuuaauaccua

SEQ ID NO: 1591128 - RNA, 19 nt, Homo sapiens
acaggaggauuaaaggauu

SEQ ID NO: 1591129 - RNA, 19 nt, Homo sapiens
gaaacuacuguaucugaug

SEQ ID NO: 1591130 - RNA, 19 nt, Homo sapiens
ugaaguaacugaggcuuag

SEQ ID NO: 1591131 - RNA, 19 nt, Homo sapiens
aacaggauaugcuuuaaga

SEQ ID NO: 1591132 - RNA, 19 nt, Homo sapiens
uggacaaaguucuguauau

SEQ ID NO: 1591133 - RNA, 19 nt, Homo sapiens
aacauaagcuaccugaaug

SEQ ID NO: 1591134 - RNA, 19 nt, Homo sapiens
caaaaugucuacuguguuc

SEQ ID NO: 1591135 - RNA, 19 nt, Homo sapiens
caaggcagguagaucacuu

SEQ ID NO: 1591136 - RNA, 19 nt, Homo sapiens
ccuguaaucccaacacuuu

SEQ ID NO: 1591137 - RNA, 19 nt, Homo sapiens
uaagggaaguuuagaugag

SEQ ID NO: 1591138 - RNA, 19 nt, Homo sapiens
ccguugaguuucuaaauau

SEQ ID NO: 1591139 - RNA, 19 nt, Homo sapiens
gagauaugcauucaagaga

SEQ ID NO: 1591140 - RNA, 19 nt, Homo sapiens
acucaugacugaagggaaa

SEQ ID NO: 1591141 - RNA, 19 nt, Homo sapiens
gagaguuugucgacuuugu

SEQ ID NO: 1591142 - RNA, 19 nt, Homo sapiens
aaacuacuguaucugaugu

SEQ ID NO: 1591143 - RNA, 19 nt, Homo sapiens
guaagggaaguuuagauga

SEQ ID NO: 1591144 - RNA, 19 nt, Homo sapiens
cagagaagguagauuuuaa

SEQ ID NO: 1591145 - RNA, 19 nt, Homo sapiens
ugagagaaggugaaauaaa

SEQ ID NO: 1591146 - RNA, 19 nt, Homo sapiens
gguauuccuuuauguaucu

SEQ ID NO: 1591147 - RNA, 19 nt, Homo sapiens
ucucuuauaugccagaaug

SEQ ID NO: 1591148 - RNA, 19 nt, Homo sapiens
ugaaauacacuaacaggau

SEQ ID NO: 1591149 - RNA, 19 nt, Homo sapiens
gggaacaucucuauuauua

SEQ ID NO: 1591150 - RNA, 19 nt, Homo sapiens
ggaaaggacuucuguuuaa

SEQ ID NO: 1591151 - RNA, 19 nt, Homo sapiens
ggacaaggauucagcuuua

SEQ ID NO: 1591152 - RNA, 19 nt, Homo sapiens
gaacaacguugguuucuuu

SEQ ID NO: 1591153 - RNA, 19 nt, Homo sapiens
ucaaauggcucacauauaa

SEQ ID NO: 1591154 - RNA, 19 nt, Homo sapiens
uaacaacucugaauggaua

SEQ ID NO: 1591155 - RNA, 19 nt, Homo sapiens
ugaaacaccuuacaacuuu

SEQ ID NO: 1591156 - RNA, 19 nt, Homo sapiens
ggaaauaauucaugaagug

SEQ ID NO: 1591157 - RNA, 19 nt, Homo sapiens
aagaacagcugacuaauuu

SEQ ID NO: 1591158 - RNA, 19 nt, Homo sapiens
gguagaaccuuauauauca

SEQ ID NO: 1591159 - RNA, 19 nt, Homo sapiens
gcacaagacuggccauaau

SEQ ID NO: 1591160 - RNA, 19 nt, Homo sapiens
gaaccaaucuaaggacuuu

SEQ ID NO: 1591161 - RNA, 19 nt, Homo sapiens
gcugauggguucaaauaua

SEQ ID NO: 1591162 - RNA, 19 nt, Homo sapiens
gcacagaaauaggaucuuu

SEQ ID NO: 1591163 - RNA, 19 nt, Homo sapiens
gggaagauguccacaguuu

SEQ ID NO: 1591164 - RNA, 19 nt, Homo sapiens
gcaagaaccuacagacaga

SEQ ID NO: 1591165 - RNA, 19 nt, Homo sapiens
gcagacagcucacauucuu

SEQ ID NO: 1591166 - RNA, 19 nt, Homo sapiens
uaacuagucuccaugaauu

SEQ ID NO: 1591167 - RNA, 19 nt, Homo sapiens
ggaagucacuggauaagga

SEQ ID NO: 1591168 - RNA, 19 nt, Homo sapiens
gcuuggaacuuaaaugaua

SEQ ID NO: 1591169 - RNA, 19 nt, Homo sapiens
ggaaauaacuaggaaagug

SEQ ID NO: 1591170 - RNA, 19 nt, Homo sapiens
gcucaugucuucuuccuuu

SEQ ID NO: 1591171 - RNA, 19 nt, Homo sapiens
gaagaaaccuaaauuugag

SEQ ID NO: 1591172 - RNA, 19 nt, Homo sapiens
gaaaugcgauagcucagaa

SEQ ID NO: 1591173 - RNA, 19 nt, Homo sapiens
ucacaaacuuccuauauga

SEQ ID NO: 1591174 - RNA, 19 nt, Homo sapiens
gcaaaggugugguauaauc

SEQ ID NO: 1591175 - RNA, 19 nt, Homo sapiens
gcacacagcaauaccuuua

SEQ ID NO: 1591176 - RNA, 19 nt, Homo sapiens
caauagaaaugucagauga

SEQ ID NO: 1591177 - RNA, 19 nt, Homo sapiens
uagaagaccuauuggauaa

SEQ ID NO: 1591178 - RNA, 19 nt, Homo sapiens
gaccaagcaucauuccuua

SEQ ID NO: 1591179 - RNA, 19 nt, Homo sapiens
cgaaucagcuaaauuguga

SEQ ID NO: 1591180 - RNA, 19 nt, Homo sapiens
ggacuucuaugcuuuguau

SEQ ID NO: 1591181 - RNA, 19 nt, Homo sapiens
gccaaugacuuccauaauu

SEQ ID NO: 1591182 - RNA, 19 nt, Homo sapiens
gaacaagcauauuauugga

SEQ ID NO: 1591183 - RNA, 19 nt, Homo sapiens
ucacuaaacuucaucuuug

SEQ ID NO: 1591184 - RNA, 19 nt, Homo sapiens
ucagaaaguugguguauga

SEQ ID NO: 1591185 - RNA, 19 nt, Homo sapiens
gcucagauguggcucuuaa

SEQ ID NO: 1591186 - RNA, 19 nt, Homo sapiens
ggaaaggacaguacaauug

SEQ ID NO: 1591187 - RNA, 19 nt, Homo sapiens
gaaaguggucugcauaauu

SEQ ID NO: 1591188 - RNA, 19 nt, Homo sapiens
ucaaacagcugcucauaau

SEQ ID NO: 1591189 - RNA, 19 nt, Homo sapiens
ggaaucaguuugaagaaga

SEQ ID NO: 1591190 - RNA, 19 nt, Homo sapiens
gaacagauccugaacucuu

SEQ ID NO: 1591191 - RNA, 19 nt, Homo sapiens
gcaccugaauuuauuagaa

SEQ ID NO: 1591192 - RNA, 19 nt, Homo sapiens
ggaaucccaucaugacuuu

SEQ ID NO: 1591193 - RNA, 19 nt, Homo sapiens
gaggauuacuccagaauga

SEQ ID NO: 1591194 - RNA, 19 nt, Homo sapiens
ggacagcaccugaauuuau

SEQ ID NO: 1591195 - RNA, 19 nt, Homo sapiens
guagaacucugcuauaauc

SEQ ID NO: 1591196 - RNA, 19 nt, Homo sapiens
gaaaacaaguggcaucuuu

SEQ ID NO: 1591197 - RNA, 19 nt, Homo sapiens
gagauuaguuggugcuauu

SEQ ID NO: 1591198 - RNA, 19 nt, Homo sapiens
gaagcaagccuuuccugua

SEQ ID NO: 1591199 - RNA, 19 nt, Homo sapiens
gagacauucuuguguuaua

SEQ ID NO: 1591200 - RNA, 19 nt, Homo sapiens
cauaguagauuucacagaa

SEQ ID NO: 1591201 - RNA, 19 nt, Homo sapiens
gaaaggacaguacaauuga

SEQ ID NO: 1591202 - RNA, 19 nt, Homo sapiens
gagaagaaaccuaaauuug

SEQ ID NO: 1591203 - RNA, 19 nt, Homo sapiens
gcuaagagaagcaauagua

SEQ ID NO: 1591204 - RNA, 19 nt, Homo sapiens
gcaacgaagugauuuggaa

SEQ ID NO: 1591205 - RNA, 19 nt, Homo sapiens
guuuauggcuguaugauuu

SEQ ID NO: 1591206 - RNA, 19 nt, Homo sapiens
gaagugagcugaccuacac

SEQ ID NO: 1591207 - RNA, 19 nt, Homo sapiens
ugaagaauaucaccaaguu

SEQ ID NO: 1591208 - RNA, 19 nt, Homo sapiens
ccacaaagauguuauugca

SEQ ID NO: 1591209 - RNA, 19 nt, Homo sapiens
gaacuuguacugaauguga

SEQ ID NO: 1591210 - RNA, 19 nt, Homo sapiens
acaagcacauuccaaguua

SEQ ID NO: 1591211 - RNA, 19 nt, Homo sapiens
acaaaggcaugaaugauuu

SEQ ID NO: 1591212 - RNA, 19 nt, Homo sapiens
gacagcaccugaauuuauu

SEQ ID NO: 1591213 - RNA, 19 nt, Homo sapiens
cauaagauauuaccguuug

SEQ ID NO: 1591214 - RNA, 19 nt, Homo sapiens
gcaauuccauuuaucacuu

SEQ ID NO: 1591215 - RNA, 19 nt, Homo sapiens
ucaauccacuacugaaaua

SEQ ID NO: 1591216 - RNA, 19 nt, Homo sapiens
agaaagagaugauugacuu

SEQ ID NO: 1591217 - RNA, 19 nt, Homo sapiens
caacagagauggcaagacu

SEQ ID NO: 1591218 - RNA, 19 nt, Homo sapiens
gauacugaccuucaaauaa

SEQ ID NO: 1591219 - RNA, 19 nt, Homo sapiens
ugaaagaccuaacccaaga

SEQ ID NO: 1591220 - RNA, 19 nt, Homo sapiens
ggacuguugugcuauugua

SEQ ID NO: 1591221 - RNA, 19 nt, Homo sapiens
ugaaucuccuuguuaguua

SEQ ID NO: 1591222 - RNA, 19 nt, Homo sapiens
gcagcaaacucuacaaucu

SEQ ID NO: 1591223 - RNA, 19 nt, Homo sapiens
gauaaggcaucucauuuua

SEQ ID NO: 1591224 - RNA, 19 nt, Homo sapiens
caagacagauugaugaaca

SEQ ID NO: 1591225 - RNA, 19 nt, Homo sapiens
gaauggaaauaacuaggaa

SEQ ID NO: 1591226 - RNA, 19 nt, Homo sapiens
ggaaaccauaucucaauua

SEQ ID NO: 1591227 - RNA, 19 nt, Homo sapiens
uaaagcacaugaacucuug

SEQ ID NO: 1591228 - RNA, 19 nt, Homo sapiens
gaaauaccugggaggauua

SEQ ID NO: 1591229 - RNA, 19 nt, Homo sapiens
ugugggaacuggcaauuua

SEQ ID NO: 1591230 - RNA, 19 nt, Homo sapiens
cagaugaaauuccuaauca

SEQ ID NO: 1591231 - RNA, 19 nt, Homo sapiens
caaagcaccuucuaaugau

SEQ ID NO: 1591232 - RNA, 19 nt, Homo sapiens
gaaguggcccaauauguaa

SEQ ID NO: 1591233 - RNA, 19 nt, Homo sapiens
gacaccagcuucuuuguga

SEQ ID NO: 1591234 - RNA, 19 nt, Homo sapiens
gagcugaccuacaccauuc

SEQ ID NO: 1591235 - RNA, 19 nt, Homo sapiens
gaagaacuauggcccaagu

SEQ ID NO: 1591236 - RNA, 19 nt, Homo sapiens
ccaguauacuugaucauuu

SEQ ID NO: 1591237 - RNA, 19 nt, Homo sapiens
caacuuaacaacagacuuu

SEQ ID NO: 1591238 - RNA, 19 nt, Homo sapiens
guagaagaccuauuggaua

SEQ ID NO: 1591239 - RNA, 19 nt, Homo sapiens
caagagaguuuccagaaca

SEQ ID NO: 1591240 - RNA, 19 nt, Homo sapiens
ugaaggagauucccacaga

SEQ ID NO: 1591241 - RNA, 19 nt, Homo sapiens
gaggaaaggacuucuguuu

SEQ ID NO: 1591242 - RNA, 19 nt, Homo sapiens
gagacuauauaucaccuaa

SEQ ID NO: 1591243 - RNA, 19 nt, Homo sapiens
ucacuuagcuaguuaccuu

SEQ ID NO: 1591244 - RNA, 19 nt, Homo sapiens
gaacauagauuuuguacgu

SEQ ID NO: 1591245 - RNA, 19 nt, Homo sapiens
ucaagugggucuuuacuau

SEQ ID NO: 1591246 - RNA, 19 nt, Homo sapiens
uggcaaaggugugguauaa

SEQ ID NO: 1591247 - RNA, 19 nt, Homo sapiens
ugaaagacauggcuugugu

SEQ ID NO: 1591248 - RNA, 19 nt, Homo sapiens
gaauagcucucuggaggaa

SEQ ID NO: 1591249 - RNA, 19 nt, Homo sapiens
gaacacagcuauacaggaa

SEQ ID NO: 1591250 - RNA, 19 nt, Homo sapiens
ggaaguagaacuagcuuua

SEQ ID NO: 1591251 - RNA, 19 nt, Homo sapiens
gacaauauccuacccauuu

SEQ ID NO: 1591252 - RNA, 19 nt, Homo sapiens
cugaauaucuuugcucuua

SEQ ID NO: 1591253 - RNA, 19 nt, Homo sapiens
aaacaggguugguuauauu

SEQ ID NO: 1591254 - RNA, 19 nt, Homo sapiens
uaaaggaaauggugcaaug

SEQ ID NO: 1591255 - RNA, 19 nt, Homo sapiens
uaucgugguuuaucucuua

SEQ ID NO: 1591256 - RNA, 19 nt, Homo sapiens
ugccaaacauuauaccuua

SEQ ID NO: 1591257 - RNA, 19 nt, Homo sapiens
ggucugaugccuacuauuu

SEQ ID NO: 1591258 - RNA, 19 nt, Homo sapiens
uuacaagcauuuaggagua

SEQ ID NO: 1591259 - RNA, 19 nt, Homo sapiens
gaaggugguuucuuuggau

SEQ ID NO: 1591260 - RNA, 19 nt, Homo sapiens
ggaaauggugcaaugauga

SEQ ID NO: 1591261 - RNA, 19 nt, Homo sapiens
ugaagaagcuggacauggu

SEQ ID NO: 1591262 - RNA, 19 nt, Homo sapiens
ggaaggugguuucuuugga

SEQ ID NO: 1591263 - RNA, 19 nt, Homo sapiens
gaacugcuuaccauacuuu

SEQ ID NO: 1591264 - RNA, 19 nt, Homo sapiens
uaaacaggguugguuauau

SEQ ID NO: 1591265 - RNA, 19 nt, Homo sapiens
gaaguagaacuagcuuuaa

SEQ ID NO: 1591266 - RNA, 19 nt, Homo sapiens
cuacgaagcugggaauuuc

SEQ ID NO: 1591267 - RNA, 19 nt, Homo sapiens
cagcaguuaucuguacuua

SEQ ID NO: 1591268 - RNA, 19 nt, Homo sapiens
gaugauuugcucuauagua

SEQ ID NO: 1591269 - RNA, 19 nt, Homo sapiens
acacuucuuuccuucauuu

SEQ ID NO: 1591270 - RNA, 19 nt, Homo sapiens
gcagguaugacagcaguua

SEQ ID NO: 1591271 - RNA, 19 nt, Homo sapiens
gcaauagcgcagacaauau

SEQ ID NO: 1591272 - RNA, 19 nt, Homo sapiens
gcaguuaucuguacuuacc

SEQ ID NO: 1591273 - RNA, 19 nt, Homo sapiens
gcaauaugaagacguagaa

SEQ ID NO: 1591274 - RNA, 19 nt, Homo sapiens
acacagcuauacaggaauu

SEQ ID NO: 1591275 - RNA, 19 nt, Homo sapiens
caacuaguucuuccaugua

SEQ ID NO: 1591276 - RNA, 19 nt, Homo sapiens
ucaacuaguucuuccaugu

SEQ ID NO: 1591277 - RNA, 19 nt, Homo sapiens
aaauaaacaggguugguua

SEQ ID NO: 1591278 - RNA, 19 nt, Homo sapiens
gucaugcuguucaaaguuu

SEQ ID NO: 1591279 - RNA, 19 nt, Homo sapiens
aaucagaacugcuuaccau

SEQ ID NO: 1591280 - RNA, 19 nt, Homo sapiens
ucacaaaucagaacugcuu

SEQ ID NO: 1591281 - RNA, 19 nt, Homo sapiens
ccaaagugcugggauuaca

SEQ ID NO: 1591282 - RNA, 19 nt, Homo sapiens
guacuuacccucuugacau

SEQ ID NO: 1591283 - RNA, 19 nt, Homo sapiens
ggucaugugcacagauuaa

SEQ ID NO: 1591284 - RNA, 19 nt, Homo sapiens
caugaaaccccacuuaaua

SEQ ID NO: 1591285 - RNA, 19 nt, Homo sapiens
aaaggacucuaucgugguu

SEQ ID NO: 1591286 - RNA, 19 nt, Homo sapiens
aagucuugcucaaauguua

SEQ ID NO: 1591287 - RNA, 19 nt, Homo sapiens
caucagacaauccuaaugu

SEQ ID NO: 1591288 - RNA, 19 nt, Homo sapiens
auaugcagguguuucauuu

SEQ ID NO: 1591289 - RNA, 19 nt, Homo sapiens
gaaauggugcaaugaugau

SEQ ID NO: 1591290 - RNA, 19 nt, Homo sapiens
ugaagacguagaaauguaa

SEQ ID NO: 1591291 - RNA, 19 nt, Homo sapiens
gaaacagccagcauugaca

SEQ ID NO: 1591292 - RNA, 19 nt, Homo sapiens
cacaagagccacugguauu

SEQ ID NO: 1591293 - RNA, 19 nt, Homo sapiens
acaauauccuacccauuug

SEQ ID NO: 1591294 - RNA, 19 nt, Homo sapiens
caggucaugugcacagauu

SEQ ID NO: 1591295 - RNA, 19 nt, Homo sapiens
uuauggcauuugagcauua

SEQ ID NO: 1591296 - RNA, 19 nt, Homo sapiens
gaggcgggauggaggaguu

SEQ ID NO: 1591297 - RNA, 19 nt, Homo sapiens
gaggucugaugccuacuau

SEQ ID NO: 1591298 - RNA, 19 nt, Homo sapiens
gugcaaugaugauucgaau

SEQ ID NO: 1591299 - RNA, 19 nt, Homo sapiens
uaugaaguaugucuaugga

SEQ ID NO: 1591300 - RNA, 19 nt, Homo sapiens
caauccaguuuauggcauu

SEQ ID NO: 1591301 - RNA, 19 nt, Homo sapiens
gaagacguagaaauguaaa

SEQ ID NO: 1591302 - RNA, 19 nt, Homo sapiens
augaagacguagaaaugua

SEQ ID NO: 1591303 - RNA, 19 nt, Homo sapiens
uuuguuaucucucuucuca

SEQ ID NO: 1591304 - RNA, 19 nt, Homo sapiens
caauagcgcagacaauauc

SEQ ID NO: 1591305 - RNA, 19 nt, Homo sapiens
cuaagcugaugcuggcuaa

SEQ ID NO: 1591306 - RNA, 19 nt, Homo sapiens
aaacacuucuuuccuucau

SEQ ID NO: 1591307 - RNA, 19 nt, Homo sapiens
uauuuacccugucacaaga

SEQ ID NO: 1591308 - RNA, 19 nt, Homo sapiens
cgugguuuaucucuuaauu

SEQ ID NO: 1591309 - RNA, 19 nt, Homo sapiens
cgaaugcaauuaggaacug

SEQ ID NO: 1591310 - RNA, 19 nt, Homo sapiens
gaacuccugaccucaagug

SEQ ID NO: 1591311 - RNA, 19 nt, Homo sapiens
ucuggaagcugaggugaga

SEQ ID NO: 1591312 - RNA, 19 nt, Homo sapiens
gaaggggccugagcaguga

SEQ ID NO: 1591313 - RNA, 19 nt, Homo sapiens
ucacuugagcccuggaauu

SEQ ID NO: 1591314 - RNA, 19 nt, Homo sapiens
gagguugccauuagcuuug

SEQ ID NO: 1591315 - RNA, 19 nt, Homo sapiens
uucaagagguugccauuag

SEQ ID NO: 1591316 - RNA, 19 nt, Homo sapiens
guucaagagguugccauua

SEQ ID NO: 1591317 - RNA, 19 nt, Homo sapiens
ccaaacauuauaccuuaga

SEQ ID NO: 1591318 - RNA, 19 nt, Homo sapiens
aacuaguucuuccauguaa

SEQ ID NO: 1591319 - RNA, 19 nt, Homo sapiens
gagguacuaugagugacuu

SEQ ID NO: 1591320 - RNA, 19 nt, Homo sapiens
cagaacugcuuaccauacu

SEQ ID NO: 1591321 - RNA, 19 nt, Homo sapiens
ucacaagagccacugguau

SEQ ID NO: 1591322 - RNA, 19 nt, Homo sapiens
aggacucuaucgugguuua

SEQ ID NO: 1591323 - RNA, 19 nt, Homo sapiens
aagcucacaaucaccauua

SEQ ID NO: 1591324 - RNA, 19 nt, Homo sapiens
agugcaauaugaagacgua

SEQ ID NO: 1591325 - RNA, 19 nt, Homo sapiens
uaugagguacuaugaguga

SEQ ID NO: 1591326 - RNA, 19 nt, Homo sapiens
aaagguagccauguagaga

SEQ ID NO: 1591327 - RNA, 19 nt, Homo sapiens
acaagagccacugguauuu

SEQ ID NO: 1591328 - RNA, 19 nt, Homo sapiens
ggacaccauggaauucgaa

SEQ ID NO: 1591329 - RNA, 19 nt, Homo sapiens
gagcaauagcgcagacaau

SEQ ID NO: 1591330 - RNA, 19 nt, Homo sapiens
ucugaugccuacuauuuua

SEQ ID NO: 1591331 - RNA, 19 nt, Homo sapiens
auucgaaucuuucccuaug

SEQ ID NO: 1591332 - RNA, 19 nt, Homo sapiens
ucuaagguauuaugaugca

SEQ ID NO: 1591333 - RNA, 19 nt, Homo sapiens
aagagccacugguauuuua

SEQ ID NO: 1591334 - RNA, 19 nt, Homo sapiens
aggaaauggugcaaugaug

SEQ ID NO: 1591335 - RNA, 19 nt, Homo sapiens
uaugaaacagccagcauug

SEQ ID NO: 1591336 - RNA, 19 nt, Homo sapiens
agcaauagcgcagacaaua

SEQ ID NO: 1591337 - RNA, 19 nt, Homo sapiens
ugagugacuuacauguguu

SEQ ID NO: 1591338 - RNA, 19 nt, Homo sapiens
ucucucuucucacaauuau

SEQ ID NO: 1591339 - RNA, 19 nt, Homo sapiens
gaaugcaauuaggaacugu

SEQ ID NO: 1591340 - RNA, 19 nt, Homo sapiens
cauaugcagguguuucauu

SEQ ID NO: 1591341 - RNA, 19 nt, Homo sapiens
cagcuauacaggaauuauu

SEQ ID NO: 1591342 - RNA, 19 nt, Homo sapiens
uguuaucucucuucucaca

SEQ ID NO: 1591343 - RNA, 19 nt, Homo sapiens
uaccuuagaacauugaaga

SEQ ID NO: 1591344 - RNA, 19 nt, Homo sapiens
caauauccuacccauuuga

SEQ ID NO: 1591345 - RNA, 19 nt, Homo sapiens
uaucuguacuuacccucuu

SEQ ID NO: 1591346 - RNA, 19 nt, Homo sapiens
auaugaagacguagaaaug

SEQ ID NO: 1591347 - RNA, 19 nt, Homo sapiens
gccagccuaugcaacauca

SEQ ID NO: 1591348 - RNA, 19 nt, Homo sapiens
gggcauguggucccagcua

SEQ ID NO: 1591349 - RNA, 19 nt, Homo sapiens
gaagagagcucaagacuuu

SEQ ID NO: 1591350 - RNA, 19 nt, Homo sapiens
gaagcaagcuaaagaauga

SEQ ID NO: 1591351 - RNA, 19 nt, Homo sapiens
gaaaugcacuuaaacaaug

SEQ ID NO: 1591352 - RNA, 19 nt, Homo sapiens
gaacagagaguuauuaaga

SEQ ID NO: 1591353 - RNA, 19 nt, Homo sapiens
gcaaacauuucaacuauga

SEQ ID NO: 1591354 - RNA, 19 nt, Homo sapiens
agaaaugccugaaagcuua

SEQ ID NO: 1591355 - RNA, 19 nt, Homo sapiens
gagcaacacugccuccuaa

SEQ ID NO: 1591356 - RNA, 19 nt, Homo sapiens
gcucaagacuuucuguuaa

SEQ ID NO: 1591357 - RNA, 19 nt, Homo sapiens
gagaaaugguguccucuuu

SEQ ID NO: 1591358 - RNA, 19 nt, Homo sapiens
gagcaggaguuacagaauu

SEQ ID NO: 1591359 - RNA, 19 nt, Homo sapiens
gaggguggcuucacucgua

SEQ ID NO: 1591360 - RNA, 19 nt, Homo sapiens
ggucaagacuuaauucaau

SEQ ID NO: 1591361 - RNA, 19 nt, Homo sapiens
ggaacaagcaguagagaaa

SEQ ID NO: 1591362 - RNA, 19 nt, Homo sapiens
gaaugcuucucgaugaaua

SEQ ID NO: 1591363 - RNA, 19 nt, Homo sapiens
gcauuccgauucuauguaa

SEQ ID NO: 1591364 - RNA, 19 nt, Homo sapiens
gaaaugguguccucuuuac

SEQ ID NO: 1591365 - RNA, 19 nt, Homo sapiens
caacggaaauguuuacaag

SEQ ID NO: 1591366 - RNA, 19 nt, Homo sapiens
ccaaauggauacuauggaa

SEQ ID NO: 1591367 - RNA, 19 nt, Homo sapiens
gaacaagaggccauucaaa

SEQ ID NO: 1591368 - RNA, 19 nt, Homo sapiens
gaaagacaauucgccagaa

SEQ ID NO: 1591369 - RNA, 19 nt, Homo sapiens
gaaaucagaaaugcacuua

SEQ ID NO: 1591370 - RNA, 19 nt, Homo sapiens
gcacuuaaaccaccaaugu

SEQ ID NO: 1591371 - RNA, 19 nt, Homo sapiens
uaaagucacugguacuaug

SEQ ID NO: 1591372 - RNA, 19 nt, Homo sapiens
caagaggccauucaaagua

SEQ ID NO: 1591373 - RNA, 19 nt, Homo sapiens
ggaaggucauuaaagaaga

SEQ ID NO: 1591374 - RNA, 19 nt, Homo sapiens
uugaagagauccagcauuu

SEQ ID NO: 1591375 - RNA, 19 nt, Homo sapiens
ggagauacuugcagagcuu

SEQ ID NO: 1591376 - RNA, 19 nt, Homo sapiens
gaacagcauuggcucucaa

SEQ ID NO: 1591377 - RNA, 19 nt, Homo sapiens
gaucucagaaucauuguuu

SEQ ID NO: 1591378 - RNA, 19 nt, Homo sapiens
gaugauuucugucacauag

SEQ ID NO: 1591379 - RNA, 19 nt, Homo sapiens
cgacaaacaucuuucuuac

SEQ ID NO: 1591380 - RNA, 19 nt, Homo sapiens
uuuacaaggucaagacuua

SEQ ID NO: 1591381 - RNA, 19 nt, Homo sapiens
gaauucagaugcgaguaaa

SEQ ID NO: 1591382 - RNA, 19 nt, Homo sapiens
ugacaaagagcaggaguua

SEQ ID NO: 1591383 - RNA, 19 nt, Homo sapiens
cauauuaccacuccguuua

SEQ ID NO: 1591384 - RNA, 19 nt, Homo sapiens
ccaaagcagcggaucaaua

SEQ ID NO: 1591385 - RNA, 19 nt, Homo sapiens
ggacaacuccauagugaau

SEQ ID NO: 1591386 - RNA, 19 nt, Homo sapiens
ggacaaguauaugaagaau

SEQ ID NO: 1591387 - RNA, 19 nt, Homo sapiens
gcccaggauucacacaaua

SEQ ID NO: 1591388 - RNA, 19 nt, Homo sapiens
aaauggagcuuucacagau

SEQ ID NO: 1591389 - RNA, 19 nt, Homo sapiens
gcauuagugugaugauuuc

SEQ ID NO: 1591390 - RNA, 19 nt, Homo sapiens
acaggaagcuucaauuucu

SEQ ID NO: 1591391 - RNA, 19 nt, Homo sapiens
gaacagcagcuuucaagag

SEQ ID NO: 1591392 - RNA, 19 nt, Homo sapiens
ucaagccaaucaugacuuu

SEQ ID NO: 1591393 - RNA, 19 nt, Homo sapiens
ggaguuacagaauuuauug

SEQ ID NO: 1591394 - RNA, 19 nt, Homo sapiens
caacacugccuccuaauuc

SEQ ID NO: 1591395 - RNA, 19 nt, Homo sapiens
guagaacagagaguuauua

SEQ ID NO: 1591396 - RNA, 19 nt, Homo sapiens
guuugugacucaauucuuu

SEQ ID NO: 1591397 - RNA, 19 nt, Homo sapiens
uggcuucacucguaaauau

SEQ ID NO: 1591398 - RNA, 19 nt, Homo sapiens
agacccaguuuaauaauga

SEQ ID NO: 1591399 - RNA, 19 nt, Homo sapiens
gaugcaaacauuucaacua

SEQ ID NO: 1591400 - RNA, 19 nt, Homo sapiens
uuaauucuauggugucuga

SEQ ID NO: 1591401 - RNA, 19 nt, Homo sapiens
uaccaaggaugcauuucua

SEQ ID NO: 1591402 - RNA, 19 nt, Homo sapiens
aauauucgcuuagcucaaa

SEQ ID NO: 1591403 - RNA, 19 nt, Homo sapiens
ggaagcaagcuaaagaaug

SEQ ID NO: 1591404 - RNA, 19 nt, Homo sapiens
gcaacacugccuccuaauu

SEQ ID NO: 1591405 - RNA, 19 nt, Homo sapiens
ggacugaacagcagcuuuc

SEQ ID NO: 1591406 - RNA, 19 nt, Homo sapiens
gcgacgcugugaagaauga

SEQ ID NO: 1591407 - RNA, 19 nt, Homo sapiens
gcaauuaauggaaacuuug

SEQ ID NO: 1591408 - RNA, 19 nt, Homo sapiens
gagacccaguuuaauaaug

SEQ ID NO: 1591409 - RNA, 19 nt, Homo sapiens
uuaccacggugcauucuuu

SEQ ID NO: 1591410 - RNA, 19 nt, Homo sapiens
gaucaauaccugucucaga

SEQ ID NO: 1591411 - RNA, 19 nt, Homo sapiens
caaagcagcggaucaauac

SEQ ID NO: 1591412 - RNA, 19 nt, Homo sapiens
gcagugaaaucagaaaugc

SEQ ID NO: 1591413 - RNA, 19 nt, Homo sapiens
cagaagcucuaacugacaa

SEQ ID NO: 1591414 - RNA, 19 nt, Homo sapiens
acucguaaauauucgcuua

SEQ ID NO: 1591415 - RNA, 19 nt, Homo sapiens
ccauggagacccaguuuaa

SEQ ID NO: 1591416 - RNA, 19 nt, Homo sapiens
uauggugucugauauugaa

SEQ ID NO: 1591417 - RNA, 19 nt, Homo sapiens
aaucucaccuugaacaaug

SEQ ID NO: 1591418 - RNA, 19 nt, Homo sapiens
aaagagagcagugcauauu

SEQ ID NO: 1591419 - RNA, 19 nt, Homo sapiens
gcaguggcuugaagagaau

SEQ ID NO: 1591420 - RNA, 19 nt, Homo sapiens
gaggaagugucauuaacca

SEQ ID NO: 1591421 - RNA, 19 nt, Homo sapiens
caaauggagcuuucacaga

SEQ ID NO: 1591422 - RNA, 19 nt, Homo sapiens
gaacaaugcauccaguuuu

SEQ ID NO: 1591423 - RNA, 19 nt, Homo sapiens
ggacaaugcaauuaaugga

SEQ ID NO: 1591424 - RNA, 19 nt, Homo sapiens
caagguugauacgcucaua

SEQ ID NO: 1591425 - RNA, 19 nt, Homo sapiens
ucaaagagagcagugcaua

SEQ ID NO: 1591426 - RNA, 19 nt, Homo sapiens
gagcuugucaugcacacua

SEQ ID NO: 1591427 - RNA, 19 nt, Homo sapiens
gaacaagcaguagagaaau

SEQ ID NO: 1591428 - RNA, 19 nt, Homo sapiens
ugcauaaucucaccuugaa

SEQ ID NO: 1591429 - RNA, 19 nt, Homo sapiens
gaaggucauuaaagaagag

SEQ ID NO: 1591430 - RNA, 19 nt, Homo sapiens
cgaaaauccuguuaucauu

SEQ ID NO: 1591431 - RNA, 19 nt, Homo sapiens
gaaugaggguggcuucacu

SEQ ID NO: 1591432 - RNA, 19 nt, Homo sapiens
caauaccugucucagaaga

SEQ ID NO: 1591433 - RNA, 19 nt, Homo sapiens
gccauucaaaguaucauua

SEQ ID NO: 1591434 - RNA, 19 nt, Homo sapiens
agaaaugguguccucuuua

SEQ ID NO: 1591435 - RNA, 19 nt, Homo sapiens
cuaauucaccaaauggaua

SEQ ID NO: 1591436 - RNA, 19 nt, Homo sapiens
aacagcagcuuucaagaga

SEQ ID NO: 1591437 - RNA, 19 nt, Homo sapiens
acaaagagcaggaguuaca

SEQ ID NO: 1591438 - RNA, 19 nt, Homo sapiens
aaucugguaucuacacuga

SEQ ID NO: 1591439 - RNA, 19 nt, Homo sapiens
cagcaugucguuaauucua

SEQ ID NO: 1591440 - RNA, 19 nt, Homo sapiens
gcacacuacuuagauuucu

SEQ ID NO: 1591441 - RNA, 19 nt, Homo sapiens
ugaaggaguuugcuuacca

SEQ ID NO: 1591442 - RNA, 19 nt, Homo sapiens
gcuagucuauccggaagaa

SEQ ID NO: 1591443 - RNA, 19 nt, Homo sapiens
gcuucucgaugaauacauu

SEQ ID NO: 1591444 - RNA, 19 nt, Homo sapiens
uaaagaagagagcucaaga

SEQ ID NO: 1591445 - RNA, 19 nt, Homo sapiens
ugaaaggguugauuugaac

SEQ ID NO: 1591446 - RNA, 19 nt, Homo sapiens
uugaaaggguugauuugaa

SEQ ID NO: 1591447 - RNA, 19 nt, Homo sapiens
gcgcucaacaccuuguaua

SEQ ID NO: 1591448 - RNA, 19 nt, Homo sapiens
gggauuggcaucaaagaga

SEQ ID NO: 1591449 - RNA, 19 nt, Homo sapiens
gcacauagcuaaaucacaa

SEQ ID NO: 1591450 - RNA, 19 nt, Homo sapiens
ggaacgagcugcaguuuga

SEQ ID NO: 1591451 - RNA, 19 nt, Homo sapiens
guacgugaauguuuaaugu

SEQ ID NO: 1591452 - RNA, 19 nt, Homo sapiens
gcaauagguuccaauaugc

SEQ ID NO: 1591453 - RNA, 19 nt, Homo sapiens
gugcguagccuccguguaa

SEQ ID NO: 1591454 - RNA, 19 nt, Homo sapiens
gcuguuaaaucaccuuaug

SEQ ID NO: 1591455 - RNA, 19 nt, Homo sapiens
ccacucccauggcuuaauu

SEQ ID NO: 1591456 - RNA, 19 nt, Homo sapiens
acauucagcuguuugguuu

SEQ ID NO: 1591457 - RNA, 19 nt, Homo sapiens
gaagauacauguguuugac

SEQ ID NO: 1591458 - RNA, 19 nt, Homo sapiens
ucacgaagauacauguguu

SEQ ID NO: 1591459 - RNA, 19 nt, Homo sapiens
ccacaucacaugaccuuaa

SEQ ID NO: 1591460 - RNA, 19 nt, Homo sapiens
aagcuuguauucaguguuu

SEQ ID NO: 1591461 - RNA, 19 nt, Homo sapiens
gaguuacugugaagaaguu

SEQ ID NO: 1591462 - RNA, 19 nt, Homo sapiens
cguuguacgugaauguuua

SEQ ID NO: 1591463 - RNA, 19 nt, Homo sapiens
ugcaauagguuccaauaug

SEQ ID NO: 1591464 - RNA, 19 nt, Homo sapiens
caacagugcgucugaggaa

SEQ ID NO: 1591465 - RNA, 19 nt, Homo sapiens
guuagugguuggauucuau

SEQ ID NO: 1591466 - RNA, 19 nt, Homo sapiens
gaccuuaacaugaucaaug

SEQ ID NO: 1591467 - RNA, 19 nt, Homo sapiens
cagcagaagucccuauuuu

SEQ ID NO: 1591468 - RNA, 19 nt, Homo sapiens
gacaucuguuuaaauggua

SEQ ID NO: 1591469 - RNA, 19 nt, Homo sapiens
guauuucucugccuugaca

SEQ ID NO: 1591470 - RNA, 19 nt, Homo sapiens
ugaaagccaggaucgguua

SEQ ID NO: 1591471 - RNA, 19 nt, Homo sapiens
gaaagggaacauagaugga

SEQ ID NO: 1591472 - RNA, 19 nt, Homo sapiens
gauagugaagcuuguauuc

SEQ ID NO: 1591473 - RNA, 19 nt, Homo sapiens
gcagcagaagucccuauuu

SEQ ID NO: 1591474 - RNA, 19 nt, Homo sapiens
uuucagugguccagcuuua

SEQ ID NO: 1591475 - RNA, 19 nt, Homo sapiens
caauggcccugccgucugu

SEQ ID NO: 1591476 - RNA, 19 nt, Homo sapiens
uuaaacagauggaguuacu

SEQ ID NO: 1591477 - RNA, 19 nt, Homo sapiens
agacaucuguuuaaauggu

SEQ ID NO: 1591478 - RNA, 19 nt, Homo sapiens
gggcuaauuacccggaaua

SEQ ID NO: 1591479 - RNA, 19 nt, Homo sapiens
cagauggaguuacugugaa

SEQ ID NO: 1591480 - RNA, 19 nt, Homo sapiens
acauguguuugacuguuua

SEQ ID NO: 1591481 - RNA, 19 nt, Homo sapiens
guguggaggugaucacgaa

SEQ ID NO: 1591482 - RNA, 19 nt, Homo sapiens
ucucugccuugacauuuaa

SEQ ID NO: 1591483 - RNA, 19 nt, Homo sapiens
caaccucucauuucacaga

SEQ ID NO: 1591484 - RNA, 19 nt, Homo sapiens
gcuuuguguugguguguaa

SEQ ID NO: 1591485 - RNA, 19 nt, Homo sapiens
cgaagauacauguguuuga

SEQ ID NO: 1591486 - RNA, 19 nt, Homo sapiens
uacauguguuugacuguuu

SEQ ID NO: 1591487 - RNA, 19 nt, Homo sapiens
gaggaacgagcugcaguuu

SEQ ID NO: 1591488 - RNA, 19 nt, Homo sapiens
uguuuaaugugcucucaaa

SEQ ID NO: 1591489 - RNA, 19 nt, Homo sapiens
gaggugaucacgaagauac

SEQ ID NO: 1591490 - RNA, 19 nt, Homo sapiens
gaaauugugagauguuuug

SEQ ID NO: 1591491 - RNA, 19 nt, Homo sapiens
gucaaccucucauuucaca

SEQ ID NO: 1591492 - RNA, 19 nt, Homo sapiens
gccuugacauuuaaauaca

SEQ ID NO: 1591493 - RNA, 19 nt, Homo sapiens
caugaucaauguauuucuc

SEQ ID NO: 1591494 - RNA, 19 nt, Homo sapiens
gcggacgcguggguuguaa

SEQ ID NO: 1591495 - RNA, 19 nt, Homo sapiens
gguacaagccaaccuaguc

SEQ ID NO: 1591496 - RNA, 19 nt, Homo sapiens
gcauuuauuagacaucugu

SEQ ID NO: 1591497 - RNA, 19 nt, Homo sapiens
caacuauuuaugcugguaa

SEQ ID NO: 1591498 - RNA, 19 nt, Homo sapiens
gguuagugguuggauucua

SEQ ID NO: 1591499 - RNA, 19 nt, Homo sapiens
ggccuucuuuccuuucugu

SEQ ID NO: 1591500 - RNA, 19 nt, Homo sapiens
gcauuggguuggacguucu

SEQ ID NO: 1591501 - RNA, 19 nt, Homo sapiens
ucagugguccagcuuuauu

SEQ ID NO: 1591502 - RNA, 19 nt, Homo sapiens
uauguacauucagcuguuu

SEQ ID NO: 1591503 - RNA, 19 nt, Homo sapiens
acaacuauuuaugcuggua

SEQ ID NO: 1591504 - RNA, 19 nt, Homo sapiens
ggaguuacugugaagaagu

SEQ ID NO: 1591505 - RNA, 19 nt, Homo sapiens
gguuggauucuauugguuu

SEQ ID NO: 1591506 - RNA, 19 nt, Homo sapiens
gugcagccacccagccuuu

SEQ ID NO: 1591507 - RNA, 19 nt, Homo sapiens
aaagggaacauagauggaa

SEQ ID NO: 1591508 - RNA, 19 nt, Homo sapiens
gugguuggauucuauuggu

SEQ ID NO: 1591509 - RNA, 19 nt, Homo sapiens
auacauguguuugacuguu

SEQ ID NO: 1591510 - RNA, 19 nt, Homo sapiens
ggaggugaucacgaagaua

SEQ ID NO: 1591511 - RNA, 19 nt, Homo sapiens
uguccacucccauggcuua

SEQ ID NO: 1591512 - RNA, 19 nt, Homo sapiens
ucacaaaacauccaauuuc

SEQ ID NO: 1591513 - RNA, 19 nt, Homo sapiens
gugagaaugcuguuauugg

SEQ ID NO: 1591514 - RNA, 19 nt, Homo sapiens
auauguacauucagcuguu

SEQ ID NO: 1591515 - RNA, 19 nt, Homo sapiens
gugcaauagguuccaauau

SEQ ID NO: 1591516 - RNA, 19 nt, Homo sapiens
ccagacgaaagcaauguug

SEQ ID NO: 1591517 - RNA, 19 nt, Homo sapiens
uuacugcgccaccacauca

SEQ ID NO: 1591518 - RNA, 19 nt, Homo sapiens
aaccuagucccacguugua

SEQ ID NO: 1591519 - RNA, 19 nt, Homo sapiens
gccucugccucucgucuga

SEQ ID NO: 1591520 - RNA, 19 nt, Homo sapiens
uagguuccaauaugcauuu

SEQ ID NO: 1591521 - RNA, 19 nt, Homo sapiens
uggaggugaucacgaagau

SEQ ID NO: 1591522 - RNA, 19 nt, Homo sapiens
uuaaugugcucucaaaaca

SEQ ID NO: 1591523 - RNA, 19 nt, Homo sapiens
guucacagcgauucaaagg

SEQ ID NO: 1591524 - RNA, 19 nt, Homo sapiens
ggucucaccgaugcaguuu

SEQ ID NO: 1591525 - RNA, 19 nt, Homo sapiens
uucucugccuugacauuua

SEQ ID NO: 1591526 - RNA, 19 nt, Homo sapiens
aaauugaaagggaacauag

SEQ ID NO: 1591527 - RNA, 19 nt, Homo sapiens
cugucaaccucucauuuca

SEQ ID NO: 1591528 - RNA, 19 nt, Homo sapiens
caucacaugaccuuaacau

SEQ ID NO: 1591529 - RNA, 19 nt, Homo sapiens
cacaucacaugaccuuaac

SEQ ID NO: 1591530 - RNA, 19 nt, Homo sapiens
aagggaacauagauggaau

SEQ ID NO: 1591531 - RNA, 19 nt, Homo sapiens
cagugguccagcuuuauuu

SEQ ID NO: 1591532 - RNA, 19 nt, Homo sapiens
gaagcuuguauucaguguu

SEQ ID NO: 1591533 - RNA, 19 nt, Homo sapiens
ugaggaacgagcugcaguu

SEQ ID NO: 1591534 - RNA, 19 nt, Homo sapiens
caccacaucacaugaccuu

SEQ ID NO: 1591535 - RNA, 19 nt, Homo sapiens
cacaaaacauccaauuucu

SEQ ID NO: 1591536 - RNA, 19 nt, Homo sapiens
gucugaccuugcagccuua

SEQ ID NO: 1591537 - RNA, 19 nt, Homo sapiens
gguccagcuuuauuuacag

SEQ ID NO: 1591538 - RNA, 19 nt, Homo sapiens
ugguccagcuuuauuuaca

SEQ ID NO: 1591539 - RNA, 19 nt, Homo sapiens
ccaaauggguguaauaaua

SEQ ID NO: 1591540 - RNA, 19 nt, Homo sapiens
caaagucgaucuugagaga

SEQ ID NO: 1591541 - RNA, 19 nt, Homo sapiens
gcacagaacggauauaauc

SEQ ID NO: 1591542 - RNA, 19 nt, Homo sapiens
gcucagcucuuuccaucua

SEQ ID NO: 1591543 - RNA, 19 nt, Homo sapiens
gaaaucagcauuccagguu

SEQ ID NO: 1591544 - RNA, 19 nt, Homo sapiens
gaacggauauaaucagucu

SEQ ID NO: 1591545 - RNA, 19 nt, Homo sapiens
uuagaaaccuugacucuga

SEQ ID NO: 1591546 - RNA, 19 nt, Homo sapiens
gguauuaauugcagggaua

SEQ ID NO: 1591547 - RNA, 19 nt, Homo sapiens
gaaccucagugcaugcaaa

SEQ ID NO: 1591548 - RNA, 19 nt, Homo sapiens
gagaaacacuggcauggau

SEQ ID NO: 1591549 - RNA, 19 nt, Homo sapiens
caacagcagugacgcauuc

SEQ ID NO: 1591550 - RNA, 19 nt, Homo sapiens
caauagaggugacugagau

SEQ ID NO: 1591551 - RNA, 19 nt, Homo sapiens
ugagagaccuggccacaug

SEQ ID NO: 1591552 - RNA, 19 nt, Homo sapiens
gaagaagacucgggagaag

SEQ ID NO: 1591553 - RNA, 19 nt, Homo sapiens
aaauacaccugccauguga

SEQ ID NO: 1591554 - RNA, 19 nt, Homo sapiens
gagaagaugaacaacauuu

SEQ ID NO: 1591555 - RNA, 19 nt, Homo sapiens
caauacccauagucaauuu

SEQ ID NO: 1591556 - RNA, 19 nt, Homo sapiens
cguaagggauguccuaaga

SEQ ID NO: 1591557 - RNA, 19 nt, Homo sapiens
acagacagcugccaucaga

SEQ ID NO: 1591558 - RNA, 19 nt, Homo sapiens
gaauugggccacagaggua

SEQ ID NO: 1591559 - RNA, 19 nt, Homo sapiens
gaaaggccaccgacaucua

SEQ ID NO: 1591560 - RNA, 19 nt, Homo sapiens
gagcacagaacggauauaa

SEQ ID NO: 1591561 - RNA, 19 nt, Homo sapiens
ugaugaaacugaugcuuga

SEQ ID NO: 1591562 - RNA, 19 nt, Homo sapiens
gaaggcagcccgaauaaac

SEQ ID NO: 1591563 - RNA, 19 nt, Homo sapiens
gaaacacuggcauggauuu

SEQ ID NO: 1591564 - RNA, 19 nt, Homo sapiens
ugaggcaucuggagacuga

SEQ ID NO: 1591565 - RNA, 19 nt, Homo sapiens
gaauaaaccccugauguua

SEQ ID NO: 1591566 - RNA, 19 nt, Homo sapiens
cagcgagacuaaagacaaa

SEQ ID NO: 1591567 - RNA, 19 nt, Homo sapiens
gcacuacuaagaaugcuaa

SEQ ID NO: 1591568 - RNA, 19 nt, Homo sapiens
gcuagaaugugccuuaguc

SEQ ID NO: 1591569 - RNA, 19 nt, Homo sapiens
gcauggauuugcacuagga

SEQ ID NO: 1591570 - RNA, 19 nt, Homo sapiens
ggcagaugcuggacauuug

SEQ ID NO: 1591571 - RNA, 19 nt, Homo sapiens
agagagagccacuuacaaa

SEQ ID NO: 1591572 - RNA, 19 nt, Homo sapiens
ggaauuauuuagucuuugc

SEQ ID NO: 1591573 - RNA, 19 nt, Homo sapiens
ggaaugacaacacggagaa

SEQ ID NO: 1591574 - RNA, 19 nt, Homo sapiens
ccaagucuguccugucuuc

SEQ ID NO: 1591575 - RNA, 19 nt, Homo sapiens
gaaaccaccuucaaaagug

SEQ ID NO: 1591576 - RNA, 19 nt, Homo sapiens
gcaaauacaccugccaugu

SEQ ID NO: 1591577 - RNA, 19 nt, Homo sapiens
ggaagauucaggagaaaga

SEQ ID NO: 1591578 - RNA, 19 nt, Homo sapiens
ggcucaaacuguagucuuu

SEQ ID NO: 1591579 - RNA, 19 nt, Homo sapiens
gaaguggacaacacaguga

SEQ ID NO: 1591580 - RNA, 19 nt, Homo sapiens
gaugacaacaauacccaua

SEQ ID NO: 1591581 - RNA, 19 nt, Homo sapiens
ggagagaacaggacuaugc

SEQ ID NO: 1591582 - RNA, 19 nt, Homo sapiens
cugcuuggcucaaacugua

SEQ ID NO: 1591583 - RNA, 19 nt, Homo sapiens
ggaagccagguauuaauug

SEQ ID NO: 1591584 - RNA, 19 nt, Homo sapiens
acagaaggcagcccgaaua

SEQ ID NO: 1591585 - RNA, 19 nt, Homo sapiens
gggaagccagguauuaauu

SEQ ID NO: 1591586 - RNA, 19 nt, Homo sapiens
caaauacaccugccaugug

SEQ ID NO: 1591587 - RNA, 19 nt, Homo sapiens
gggcagaugcuggacauuu

SEQ ID NO: 1591588 - RNA, 19 nt, Homo sapiens
ccuauaacuugcuuuacuu

SEQ ID NO: 1591589 - RNA, 19 nt, Homo sapiens
gaaucauccugucccaugu

SEQ ID NO: 1591590 - RNA, 19 nt, Homo sapiens
gcacguagaguagggagaa

SEQ ID NO: 1591591 - RNA, 19 nt, Homo sapiens
ucuuauagcuaccuucaug

SEQ ID NO: 1591592 - RNA, 19 nt, Homo sapiens
gaggguuccuggccaccua

SEQ ID NO: 1591593 - RNA, 19 nt, Homo sapiens
gggaaaauccuauaacuug

SEQ ID NO: 1591594 - RNA, 19 nt, Homo sapiens
gaagccagguauuaauugc

SEQ ID NO: 1591595 - RNA, 19 nt, Homo sapiens
cagggacucucuuccuuug

SEQ ID NO: 1591596 - RNA, 19 nt, Homo sapiens
uguggaagauucaggagaa

SEQ ID NO: 1591597 - RNA, 19 nt, Homo sapiens
ggaagaaguggacaacaca

SEQ ID NO: 1591598 - RNA, 19 nt, Homo sapiens
cauucaagauucucauaga

SEQ ID NO: 1591599 - RNA, 19 nt, Homo sapiens
caacaauacccauagucaa

SEQ ID NO: 1591600 - RNA, 19 nt, Homo sapiens
agaggugacugagauugua

SEQ ID NO: 1591601 - RNA, 19 nt, Homo sapiens
gggacucucuuccuuugga

SEQ ID NO: 1591602 - RNA, 19 nt, Homo sapiens
gaggagaaaccaccuucaa

SEQ ID NO: 1591603 - RNA, 19 nt, Homo sapiens
ugaagaaugagaagucuga

SEQ ID NO: 1591604 - RNA, 19 nt, Homo sapiens
gaugggcucugcauguaag

SEQ ID NO: 1591605 - RNA, 19 nt, Homo sapiens
uggaugggcucugcaugua

SEQ ID NO: 1591606 - RNA, 19 nt, Homo sapiens
ggaggugucugugggaaag

SEQ ID NO: 1591607 - RNA, 19 nt, Homo sapiens
cagaaggcagcccgaauaa

SEQ ID NO: 1591608 - RNA, 19 nt, Homo sapiens
ucagagcucucccugucaa

SEQ ID NO: 1591609 - RNA, 19 nt, Homo sapiens
ggagaaaccaccuucaaaa

SEQ ID NO: 1591610 - RNA, 19 nt, Homo sapiens
ggacugugaagaaugagaa

SEQ ID NO: 1591611 - RNA, 19 nt, Homo sapiens
gcaccacgccaccaucuuc

SEQ ID NO: 1591612 - RNA, 19 nt, Homo sapiens
ugacaacaauacccauagu

SEQ ID NO: 1591613 - RNA, 19 nt, Homo sapiens
gcagaugcuggacauuuga

SEQ ID NO: 1591614 - RNA, 19 nt, Homo sapiens
caaauggguguaauaauac

SEQ ID NO: 1591615 - RNA, 19 nt, Homo sapiens
auagcuaccuucaugcaaa

SEQ ID NO: 1591616 - RNA, 19 nt, Homo sapiens
gcaggaccaucgccacucu

SEQ ID NO: 1591617 - RNA, 19 nt, Homo sapiens
cuaaggagaagaugaacaa

SEQ ID NO: 1591618 - RNA, 19 nt, Homo sapiens
cuacuaaggagaagaugaa

SEQ ID NO: 1591619 - RNA, 19 nt, Homo sapiens
ccuugacucugaugcuuaa

SEQ ID NO: 1591620 - RNA, 19 nt, Homo sapiens
gaucaugcagcuucucuca

SEQ ID NO: 1591621 - RNA, 19 nt, Homo sapiens
ugacauaacagcagagucu

SEQ ID NO: 1591622 - RNA, 19 nt, Homo sapiens
gaugaacaacauuuccauu

SEQ ID NO: 1591623 - RNA, 19 nt, Homo sapiens
ccaaggugacguugaaaga

SEQ ID NO: 1591624 - RNA, 19 nt, Homo sapiens
gcagugacgcauucaagau

SEQ ID NO: 1591625 - RNA, 19 nt, Homo sapiens
agacugagaaagaaucaaa

SEQ ID NO: 1591626 - RNA, 19 nt, Homo sapiens
guccauggcuuuuguuuga

SEQ ID NO: 1591627 - RNA, 19 nt, Homo sapiens
ggucuacugcugauuucua

SEQ ID NO: 1591628 - RNA, 19 nt, Homo sapiens
gaucaagaaacucaucauc

SEQ ID NO: 1591629 - RNA, 19 nt, Homo sapiens
cagaacggauauaaucagu

SEQ ID NO: 1591630 - RNA, 19 nt, Homo sapiens
uggcuuggaugacaacaau

SEQ ID NO: 1591631 - RNA, 19 nt, Homo sapiens
caccugauaugcagugcuu

SEQ ID NO: 1591632 - RNA, 19 nt, Homo sapiens
gauuugcacuaggauguau

SEQ ID NO: 1591633 - RNA, 19 nt, Homo sapiens
ggagaaacacuggcaugga

SEQ ID NO: 1591634 - RNA, 19 nt, Homo sapiens
gaagauucaggagaaagaa

SEQ ID NO: 1591635 - RNA, 19 nt, Homo sapiens
aggagaagaugaacaacau

SEQ ID NO: 1591636 - RNA, 19 nt, Homo sapiens
cuaccaaauggguguaaua

SEQ ID NO: 1591637 - RNA, 19 nt, Homo sapiens
ggaggccucuggagaagac

SEQ ID NO: 1591638 - RNA, 19 nt, Homo sapiens
gcuggaggccucuggagaa

SEQ ID NO: 1591639 - RNA, 19 nt, Homo sapiens
gcuccaagcucauccguuu

SEQ ID NO: 1591640 - RNA, 19 nt, Homo sapiens
guacauuucuguucauuuc

SEQ ID NO: 1591641 - RNA, 19 nt, Homo sapiens
caacugugcuauucaugaa

SEQ ID NO: 1591642 - RNA, 19 nt, Homo sapiens
uagcagaccucacuucaca

SEQ ID NO: 1591643 - RNA, 19 nt, Homo sapiens
gguaagagccgaccacaag

SEQ ID NO: 1591644 - RNA, 19 nt, Homo sapiens
gaugguuuguguugggaua

SEQ ID NO: 1591645 - RNA, 19 nt, Homo sapiens
cagaugcuccuggguauua

SEQ ID NO: 1591646 - RNA, 19 nt, Homo sapiens
gaagucaggaguacauuuc

SEQ ID NO: 1591647 - RNA, 19 nt, Homo sapiens
gaaggcacaugaggacaau

SEQ ID NO: 1591648 - RNA, 19 nt, Homo sapiens
aggcucaacuggcagaaua

SEQ ID NO: 1591649 - RNA, 19 nt, Homo sapiens
gcacuguccucuguguuug

SEQ ID NO: 1591650 - RNA, 19 nt, Homo sapiens
cagagcagccugaagguaa

SEQ ID NO: 1591651 - RNA, 19 nt, Homo sapiens
ggagagcugugaugaccau

SEQ ID NO: 1591652 - RNA, 19 nt, Homo sapiens
caucugcacuguccucugu

SEQ ID NO: 1591653 - RNA, 19 nt, Homo sapiens
uuaaagcccucaagucucu

SEQ ID NO: 1591654 - RNA, 19 nt, Homo sapiens
gaaggucuauaccagaaac

SEQ ID NO: 1591655 - RNA, 19 nt, Homo sapiens
ggacaaugaaggucuauac

SEQ ID NO: 1591656 - RNA, 19 nt, Homo sapiens
gagcugugaugaccauucu

SEQ ID NO: 1591657 - RNA, 19 nt, Homo sapiens
ggaaggcacaugaggacaa

SEQ ID NO: 1591658 - RNA, 19 nt, Homo sapiens
ucaacuggcagaauaaaga

SEQ ID NO: 1591659 - RNA, 19 nt, Homo sapiens
agaccucacuucacaguca

SEQ ID NO: 1591660 - RNA, 19 nt, Homo sapiens
gaguacauuucuguucauu

SEQ ID NO: 1591661 - RNA, 19 nt, Homo sapiens
gcagauucccggacacugu

SEQ ID NO: 1591662 - RNA, 19 nt, Homo sapiens
ggaguacauuucuguucau

SEQ ID NO: 1591663 - RNA, 19 nt, Homo sapiens
ugaggacaaugaaggucua

SEQ ID NO: 1591664 - RNA, 19 nt, Homo sapiens
cauuaaagcccucaagucu

SEQ ID NO: 1591665 - RNA, 19 nt, Homo sapiens
ucucacaccuuccugaucu

SEQ ID NO: 1591666 - RNA, 19 nt, Homo sapiens
gcuccuggguauuauucuu

SEQ ID NO: 1591667 - RNA, 19 nt, Homo sapiens
gcagaauaaagaucucaau

SEQ ID NO: 1591668 - RNA, 19 nt, Homo sapiens
cuaccaagccaucaucaug

SEQ ID NO: 1591669 - RNA, 19 nt, Homo sapiens
ccuggaggcccacauuaaa

SEQ ID NO: 1591670 - RNA, 19 nt, Homo sapiens
ucauuucaguccuggaguu

SEQ ID NO: 1591671 - RNA, 19 nt, Homo sapiens
aggaguacauuucuguuca

SEQ ID NO: 1591672 - RNA, 19 nt, Homo sapiens
gcacaugaggacaaugaag

SEQ ID NO: 1591673 - RNA, 19 nt, Homo sapiens
gcaugcagccauccugauc

SEQ ID NO: 1591674 - RNA, 19 nt, Homo sapiens
ugaagucaggaguacauuu

SEQ ID NO: 1591675 - RNA, 19 nt, Homo sapiens
gcagaccucacuucacagu

SEQ ID NO: 1591676 - RNA, 19 nt, Homo sapiens
augaaggucuauaccagaa

SEQ ID NO: 1591677 - RNA, 19 nt, Homo sapiens
gcacuguguccuaugaagu

SEQ ID NO: 1591678 - RNA, 19 nt, Homo sapiens
cuucugggaugcugacugu

SEQ ID NO: 1591679 - RNA, 19 nt, Homo sapiens
cuauccagcuuacccacuu

SEQ ID NO: 1591680 - RNA, 19 nt, Homo sapiens
uauuguuucugguuucuuc

SEQ ID NO: 1591681 - RNA, 19 nt, Homo sapiens
caacuggcagaauaaagau

SEQ ID NO: 1591682 - RNA, 19 nt, Homo sapiens
gcucaacuggcagaauaaa

SEQ ID NO: 1591683 - RNA, 19 nt, Homo sapiens
caagccaucaucaugcuau

SEQ ID NO: 1591684 - RNA, 19 nt, Homo sapiens
acaacugugcuauucauga

SEQ ID NO: 1591685 - RNA, 19 nt, Homo sapiens
gugaagaggcaggcacuga

SEQ ID NO: 1591686 - RNA, 19 nt, Homo sapiens
uguggucugugccuccuuu

SEQ ID NO: 1591687 - RNA, 19 nt, Homo sapiens
cauccgcacuguguccuau

SEQ ID NO: 1591688 - RNA, 19 nt, Homo sapiens
uaacucgcauccgcacugu

SEQ ID NO: 1591689 - RNA, 19 nt, Homo sapiens
ugcuauggaugauugcaaa

SEQ ID NO: 1591690 - RNA, 19 nt, Homo sapiens
gucugugccuccuuuccua

SEQ ID NO: 1591691 - RNA, 19 nt, Homo sapiens
ccugagugcuauccagcuu

SEQ ID NO: 1591692 - RNA, 19 nt, Homo sapiens
acaccuuccugaucugcuu

SEQ ID NO: 1591693 - RNA, 19 nt, Homo sapiens
ccuaugaagucaggaguac

SEQ ID NO: 1591694 - RNA, 19 nt, Homo sapiens
ugagugcuauccagcuuac

SEQ ID NO: 1591695 - RNA, 19 nt, Homo sapiens
aaauaggggugaugguuug

SEQ ID NO: 1591696 - RNA, 19 nt, Homo sapiens
caaaauaggggugaugguu

SEQ ID NO: 1591697 - RNA, 19 nt, Homo sapiens
ucugaccaaugccuucguu

SEQ ID NO: 1591698 - RNA, 19 nt, Homo sapiens
caggaguacauuucuguuc

SEQ ID NO: 1591699 - RNA, 19 nt, Homo sapiens
gaaauugcaggcugaacuu

SEQ ID NO: 1591700 - RNA, 19 nt, Homo sapiens
ggaaggagugcuuggagaa

SEQ ID NO: 1591701 - RNA, 19 nt, Homo sapiens
gagaagcccgauggaaauu

SEQ ID NO: 1591702 - RNA, 19 nt, Homo sapiens
ggaaauugcaggcugaacu

SEQ ID NO: 1591703 - RNA, 19 nt, Homo sapiens
gaagcccgauggaaauugc

SEQ ID NO: 1591704 - RNA, 19 nt, Homo sapiens
ugagaagcccgauggaaau

SEQ ID NO: 1591705 - RNA, 19 nt, Homo sapiens
gaaggagugcuuggagaau

SEQ ID NO: 1591706 - RNA, 19 nt, Homo sapiens
aggagugcuuggagaauga

SEQ ID NO: 1591707 - RNA, 19 nt, Homo sapiens
gcaggaaggagugcuugga

SEQ ID NO: 1591708 - RNA, 19 nt, Homo sapiens
aaggagugcuuggagaaug

SEQ ID NO: 1591709 - RNA, 19 nt, Homo sapiens
augagaagcccgauggaaa

SEQ ID NO: 1591710 - RNA, 19 nt, Homo sapiens
gaaugagaagcccgaugga

SEQ ID NO: 1591711 - RNA, 19 nt, Homo sapiens
ucuauuugcuauguucuuc

SEQ ID NO: 1591712 - RNA, 19 nt, Homo sapiens
gaacaccugugaacuauug

SEQ ID NO: 1591713 - RNA, 19 nt, Homo sapiens
gaagcaauuucaacagaua

SEQ ID NO: 1591714 - RNA, 19 nt, Homo sapiens
gaacuuagugucuuuauug

SEQ ID NO: 1591715 - RNA, 19 nt, Homo sapiens
ggacaugccuauuucuuug

SEQ ID NO: 1591716 - RNA, 19 nt, Homo sapiens
gaaaccaugugcuaccaua

SEQ ID NO: 1591717 - RNA, 19 nt, Homo sapiens
gaaacugacuguauaucuu

SEQ ID NO: 1591718 - RNA, 19 nt, Homo sapiens
uaucuaagcuucggucuaa

SEQ ID NO: 1591719 - RNA, 19 nt, Homo sapiens
uggaacagcugaauucuga

SEQ ID NO: 1591720 - RNA, 19 nt, Homo sapiens
guauagauaugaaggagaa

SEQ ID NO: 1591721 - RNA, 19 nt, Homo sapiens
ggaaagagggagagaagaa

SEQ ID NO: 1591722 - RNA, 19 nt, Homo sapiens
cauguaaacuccaggauau

SEQ ID NO: 1591723 - RNA, 19 nt, Homo sapiens
gcagacaagugauaauaag

SEQ ID NO: 1591724 - RNA, 19 nt, Homo sapiens
gaacugcagaggccguuua

SEQ ID NO: 1591725 - RNA, 19 nt, Homo sapiens
gacauguccucuccucuaa

SEQ ID NO: 1591726 - RNA, 19 nt, Homo sapiens
ggucuaauguggagccaaa

SEQ ID NO: 1591727 - RNA, 19 nt, Homo sapiens
caagauugagcacaacuua

SEQ ID NO: 1591728 - RNA, 19 nt, Homo sapiens
gaacagcugaauucugaaa

SEQ ID NO: 1591729 - RNA, 19 nt, Homo sapiens
gaggauaugacacuuauug

SEQ ID NO: 1591730 - RNA, 19 nt, Homo sapiens
uaggguguguguaaacuua

SEQ ID NO: 1591731 - RNA, 19 nt, Homo sapiens
gauaauaagaguucuggaa

SEQ ID NO: 1591732 - RNA, 19 nt, Homo sapiens
gauguuaucaugcaagauu

SEQ ID NO: 1591733 - RNA, 19 nt, Homo sapiens
gaaagcaucgccuggcauu

SEQ ID NO: 1591734 - RNA, 19 nt, Homo sapiens
ggacaucagcaaauuucua

SEQ ID NO: 1591735 - RNA, 19 nt, Homo sapiens
uaaaggaaaucaucagcau

SEQ ID NO: 1591736 - RNA, 19 nt, Homo sapiens
ucaauugaaugcaccugua

SEQ ID NO: 1591737 - RNA, 19 nt, Homo sapiens
aauaagaguucuggaauug

SEQ ID NO: 1591738 - RNA, 19 nt, Homo sapiens
guaacuuccugucugauau

SEQ ID NO: 1591739 - RNA, 19 nt, Homo sapiens
cagaggauaugacacuuau

SEQ ID NO: 1591740 - RNA, 19 nt, Homo sapiens
gaagacacauuggaacuac

SEQ ID NO: 1591741 - RNA, 19 nt, Homo sapiens
gcuggaaacugaagacaca

SEQ ID NO: 1591742 - RNA, 19 nt, Homo sapiens
cagcauuucccgcuaauaa

SEQ ID NO: 1591743 - RNA, 19 nt, Homo sapiens
uaucagcauuucccuguuu

SEQ ID NO: 1591744 - RNA, 19 nt, Homo sapiens
uaagcagauugguuaagua

SEQ ID NO: 1591745 - RNA, 19 nt, Homo sapiens
aagugaaacugacuguaua

SEQ ID NO: 1591746 - RNA, 19 nt, Homo sapiens
uggcagggcucaucaggaa

SEQ ID NO: 1591747 - RNA, 19 nt, Homo sapiens
ccaaaccaaucaaacugaa

SEQ ID NO: 1591748 - RNA, 19 nt, Homo sapiens
ugucaugccuacaaucaaa

SEQ ID NO: 1591749 - RNA, 19 nt, Homo sapiens
guacagcugcauuaggaua

SEQ ID NO: 1591750 - RNA, 19 nt, Homo sapiens
caucagcauuucccgcuaa

SEQ ID NO: 1591751 - RNA, 19 nt, Homo sapiens
uaaaucagacugugaagug

SEQ ID NO: 1591752 - RNA, 19 nt, Homo sapiens
cugcuacgcugaucucauu

SEQ ID NO: 1591753 - RNA, 19 nt, Homo sapiens
gcaagagguacucaucauu

SEQ ID NO: 1591754 - RNA, 19 nt, Homo sapiens
gcagauugguuaaguaucc

SEQ ID NO: 1591755 - RNA, 19 nt, Homo sapiens
gcauuaggauacuuaacug

SEQ ID NO: 1591756 - RNA, 19 nt, Homo sapiens
gugauuacguuauuauugg

SEQ ID NO: 1591757 - RNA, 19 nt, Homo sapiens
caauaaacacgacacaguu

SEQ ID NO: 1591758 - RNA, 19 nt, Homo sapiens
uagaaacagugaaagugaa

SEQ ID NO: 1591759 - RNA, 19 nt, Homo sapiens
ugaaggauguuaucaugca

SEQ ID NO: 1591760 - RNA, 19 nt, Homo sapiens
aguauucucugcaagauug

SEQ ID NO: 1591761 - RNA, 19 nt, Homo sapiens
caggauauccguucauuca

SEQ ID NO: 1591762 - RNA, 19 nt, Homo sapiens
gaaggauguuaucaugcaa

SEQ ID NO: 1591763 - RNA, 19 nt, Homo sapiens
guaguaaccacacuuuaau

SEQ ID NO: 1591764 - RNA, 19 nt, Homo sapiens
gcagaggccguuuauucaa

SEQ ID NO: 1591765 - RNA, 19 nt, Homo sapiens
ggaaacugaagacacauug

SEQ ID NO: 1591766 - RNA, 19 nt, Homo sapiens
caagagguacucaucauuc

SEQ ID NO: 1591767 - RNA, 19 nt, Homo sapiens
gaacuauugaaggauguua

SEQ ID NO: 1591768 - RNA, 19 nt, Homo sapiens
gaaagugaaacugacugua

SEQ ID NO: 1591769 - RNA, 19 nt, Homo sapiens
caagugauaauaagaguuc

SEQ ID NO: 1591770 - RNA, 19 nt, Homo sapiens
uagcagacaagugauaaua

SEQ ID NO: 1591771 - RNA, 19 nt, Homo sapiens
ucaggaaacucggucauca

SEQ ID NO: 1591772 - RNA, 19 nt, Homo sapiens
gcagcguccucuaguggaa

SEQ ID NO: 1591773 - RNA, 19 nt, Homo sapiens
guacucaucauucccagaa

SEQ ID NO: 1591774 - RNA, 19 nt, Homo sapiens
gaggacaucagcaaauuuc

SEQ ID NO: 1591775 - RNA, 19 nt, Homo sapiens
aaagugaaacugacuguau

SEQ ID NO: 1591776 - RNA, 19 nt, Homo sapiens
gcuaauaaaggaaaucauc

SEQ ID NO: 1591777 - RNA, 19 nt, Homo sapiens
gaagcaagagguacucauc

SEQ ID NO: 1591778 - RNA, 19 nt, Homo sapiens
ugaaauugauggcauucug

SEQ ID NO: 1591779 - RNA, 19 nt, Homo sapiens
gacaucagcaaauuucuau

SEQ ID NO: 1591780 - RNA, 19 nt, Homo sapiens
gaaagagggagagaagaau

SEQ ID NO: 1591781 - RNA, 19 nt, Homo sapiens
cagaggccguuuauucaau

SEQ ID NO: 1591782 - RNA, 19 nt, Homo sapiens
ggaauugcuuacagaggau

SEQ ID NO: 1591783 - RNA, 19 nt, Homo sapiens
gacaagugauaauaagagu

SEQ ID NO: 1591784 - RNA, 19 nt, Homo sapiens
acagguagcagacaaguga

SEQ ID NO: 1591785 - RNA, 19 nt, Homo sapiens
cagcugugcauguauuuaa

SEQ ID NO: 1591786 - RNA, 19 nt, Homo sapiens
ccugugaacuauugaagga

SEQ ID NO: 1591787 - RNA, 19 nt, Homo sapiens
cauguccucuccucuaaug

SEQ ID NO: 1591788 - RNA, 19 nt, Homo sapiens
ugaaugcaccuguaacuuc

SEQ ID NO: 1591789 - RNA, 19 nt, Homo sapiens
gagccuaugucaacagcau

SEQ ID NO: 1591790 - RNA, 19 nt, Homo sapiens
uaucagagccuaugucaac

SEQ ID NO: 1591791 - RNA, 19 nt, Homo sapiens
gaaacuacuccugguguug

SEQ ID NO: 1591792 - RNA, 19 nt, Homo sapiens
uauauguacagcugcauua

SEQ ID NO: 1591793 - RNA, 19 nt, Homo sapiens
aagcuguuguggccuauuu

SEQ ID NO: 1591794 - RNA, 19 nt, Homo sapiens
gguugacguuggugcagua

SEQ ID NO: 1591795 - RNA, 19 nt, Homo sapiens
aaaguaauuuccagcagau

SEQ ID NO: 1591796 - RNA, 19 nt, Homo sapiens
ccaauaaacacgacacagu

SEQ ID NO: 1591797 - RNA, 19 nt, Homo sapiens
gugcauguauuuaagaaac

SEQ ID NO: 1591798 - RNA, 19 nt, Homo sapiens
uggaacaccugugaacuau

SEQ ID NO: 1591799 - RNA, 19 nt, Homo sapiens
aaacgcuucucccuguuga

SEQ ID NO: 1591800 - RNA, 19 nt, Homo sapiens
cuuagugucuuuauugcuu

SEQ ID NO: 1591801 - RNA, 19 nt, Homo sapiens
gacuguguauugguuaauu

SEQ ID NO: 1591802 - RNA, 19 nt, Homo sapiens
cguuauuauuggacacuua

SEQ ID NO: 1591803 - RNA, 19 nt, Homo sapiens
ugucugauauugggaaaga

SEQ ID NO: 1591804 - RNA, 19 nt, Homo sapiens
caauugaaugcaccuguaa

SEQ ID NO: 1591805 - RNA, 19 nt, Homo sapiens
gagaaaccaugugcuacca

SEQ ID NO: 1591806 - RNA, 19 nt, Homo sapiens
guugggagcccuuggagaa

SEQ ID NO: 1591807 - RNA, 19 nt, Homo sapiens
agacauguccucuccucua

SEQ ID NO: 1591808 - RNA, 19 nt, Homo sapiens
gugaagugcuugaaguuuu

SEQ ID NO: 1591809 - RNA, 19 nt, Homo sapiens
uagaaaagacuguguauug

SEQ ID NO: 1591810 - RNA, 19 nt, Homo sapiens
ccuguaacuuccugucuga

SEQ ID NO: 1591811 - RNA, 19 nt, Homo sapiens
ucauguaaacuccaggaua

SEQ ID NO: 1591812 - RNA, 19 nt, Homo sapiens
gaauguagaaucagcauaa

SEQ ID NO: 1591813 - RNA, 19 nt, Homo sapiens
gaaacaccuuugagggaua

SEQ ID NO: 1591814 - RNA, 19 nt, Homo sapiens
ucaucgagcuugcuuguuu

SEQ ID NO: 1591815 - RNA, 19 nt, Homo sapiens
gcacauaggaaaugccaaa

SEQ ID NO: 1591816 - RNA, 19 nt, Homo sapiens
gagcugaagccacagagua

SEQ ID NO: 1591817 - RNA, 19 nt, Homo sapiens
gaaaucucaugucccaguu

SEQ ID NO: 1591818 - RNA, 19 nt, Homo sapiens
gggagcagcuucugagauc

SEQ ID NO: 1591819 - RNA, 19 nt, Homo sapiens
ggguagagcuggagucaca

SEQ ID NO: 1591820 - RNA, 19 nt, Homo sapiens
uccaaagggugaauuaauu

SEQ ID NO: 1591821 - RNA, 19 nt, Homo sapiens
uaaaaucgcccucagaaua

SEQ ID NO: 1591822 - RNA, 19 nt, Homo sapiens
cauaggaaaugccaaaaua

SEQ ID NO: 1591823 - RNA, 19 nt, Homo sapiens
gagggcaccuggaacaaug

SEQ ID NO: 1591824 - RNA, 19 nt, Homo sapiens
aaagggaacugaugagagu

SEQ ID NO: 1591825 - RNA, 19 nt, Homo sapiens
gaaacaagacaaugaagca

SEQ ID NO: 1591826 - RNA, 19 nt, Homo sapiens
cagcagacccuuagcagaa

SEQ ID NO: 1591827 - RNA, 19 nt, Homo sapiens
caaugaaacaagacaauga

SEQ ID NO: 1591828 - RNA, 19 nt, Homo sapiens
cagaguaggagagaaguua

SEQ ID NO: 1591829 - RNA, 19 nt, Homo sapiens
aagcagcggugccaaguau

SEQ ID NO: 1591830 - RNA, 19 nt, Homo sapiens
gagauccaauggccuuguu

SEQ ID NO: 1591831 - RNA, 19 nt, Homo sapiens
gaacaguaaauaagacaag

SEQ ID NO: 1591832 - RNA, 19 nt, Homo sapiens
gagcacagcagacccuuag

SEQ ID NO: 1591833 - RNA, 19 nt, Homo sapiens
ggagggauguguuaaaauc

SEQ ID NO: 1591834 - RNA, 19 nt, Homo sapiens
gauggagggauguguuaaa

SEQ ID NO: 1591835 - RNA, 19 nt, Homo sapiens
ugccagacaugauuccauu

SEQ ID NO: 1591836 - RNA, 19 nt, Homo sapiens
agaauauggucgagacaau

SEQ ID NO: 1591837 - RNA, 19 nt, Homo sapiens
ggaacaauggccugcaaga

SEQ ID NO: 1591838 - RNA, 19 nt, Homo sapiens
gcagcggugccaaguauga

SEQ ID NO: 1591839 - RNA, 19 nt, Homo sapiens
gaaccuuuccuuccugcuu

SEQ ID NO: 1591840 - RNA, 19 nt, Homo sapiens
cagcauaauuuaaccucau

SEQ ID NO: 1591841 - RNA, 19 nt, Homo sapiens
gacaugauuccauuucgaa

SEQ ID NO: 1591842 - RNA, 19 nt, Homo sapiens
ggcaugggcugggcauaga

SEQ ID NO: 1591843 - RNA, 19 nt, Homo sapiens
gggcaacacugaccuuucc

SEQ ID NO: 1591844 - RNA, 19 nt, Homo sapiens
aaauuggaauccuuuaugg

SEQ ID NO: 1591845 - RNA, 19 nt, Homo sapiens
aauuuaaccucaucuugga

SEQ ID NO: 1591846 - RNA, 19 nt, Homo sapiens
ggaggauauuugaggacaa

SEQ ID NO: 1591847 - RNA, 19 nt, Homo sapiens
gaauauggucgagacaaug

SEQ ID NO: 1591848 - RNA, 19 nt, Homo sapiens
ugauucaugugcccgauug

SEQ ID NO: 1591849 - RNA, 19 nt, Homo sapiens
uaagacaagacuuugauuc

SEQ ID NO: 1591850 - RNA, 19 nt, Homo sapiens
ucgagacaaugaaacaaga

SEQ ID NO: 1591851 - RNA, 19 nt, Homo sapiens
aacuuucacucccugcuua

SEQ ID NO: 1591852 - RNA, 19 nt, Homo sapiens
gcacagcagacccuuagca

SEQ ID NO: 1591853 - RNA, 19 nt, Homo sapiens
cgagaccuaugcugaugga

SEQ ID NO: 1591854 - RNA, 19 nt, Homo sapiens
gcuuaaagggaacugauga

SEQ ID NO: 1591855 - RNA, 19 nt, Homo sapiens
gacuuugauucgcuuaguu

SEQ ID NO: 1591856 - RNA, 19 nt, Homo sapiens
gacaaugaaacaagacaau

SEQ ID NO: 1591857 - RNA, 19 nt, Homo sapiens
ggacuuugaaccuuuccuu

SEQ ID NO: 1591858 - RNA, 19 nt, Homo sapiens
agacaugauuccauuucga

SEQ ID NO: 1591859 - RNA, 19 nt, Homo sapiens
gaaccauagcugucacugu

SEQ ID NO: 1591860 - RNA, 19 nt, Homo sapiens
caagggacgcuacggaauc

SEQ ID NO: 1591861 - RNA, 19 nt, Homo sapiens
ccacagaguaggagagaag

SEQ ID NO: 1591862 - RNA, 19 nt, Homo sapiens
ugagguggcaggugucuau

SEQ ID NO: 1591863 - RNA, 19 nt, Homo sapiens
ccaagggccagggcgaaua

SEQ ID NO: 1591864 - RNA, 19 nt, Homo sapiens
ggaggguuauccuuguucu

SEQ ID NO: 1591865 - RNA, 19 nt, Homo sapiens
gcuuaguucugccuugagu

SEQ ID NO: 1591866 - RNA, 19 nt, Homo sapiens
gacuuuggaacaguaaaua

SEQ ID NO: 1591867 - RNA, 19 nt, Homo sapiens
ccauagcugucacugucuu

SEQ ID NO: 1591868 - RNA, 19 nt, Homo sapiens
gcuauggcaccgagaccua

SEQ ID NO: 1591869 - RNA, 19 nt, Homo sapiens
ccagaaggagggcaggauu

SEQ ID NO: 1591870 - RNA, 19 nt, Homo sapiens
aaccuuuccuuccugcuuu

SEQ ID NO: 1591871 - RNA, 19 nt, Homo sapiens
uaaagagaucacaccguuu

SEQ ID NO: 1591872 - RNA, 19 nt, Homo sapiens
caugaggaaugccgagucu

SEQ ID NO: 1591873 - RNA, 19 nt, Homo sapiens
gcagacccuuagcagaaca

SEQ ID NO: 1591874 - RNA, 19 nt, Homo sapiens
gaacaauggccugcaagac

SEQ ID NO: 1591875 - RNA, 19 nt, Homo sapiens
caucgagcuugcuuguuuc

SEQ ID NO: 1591876 - RNA, 19 nt, Homo sapiens
ccagacaugauuccauuuc

SEQ ID NO: 1591877 - RNA, 19 nt, Homo sapiens
caagcagcggugccaagua

SEQ ID NO: 1591878 - RNA, 19 nt, Homo sapiens
guggacacauggcuucaag

SEQ ID NO: 1591879 - RNA, 19 nt, Homo sapiens
cagaaggagggcaggauug

SEQ ID NO: 1591880 - RNA, 19 nt, Homo sapiens
gcggaccguauuagucuuu

SEQ ID NO: 1591881 - RNA, 19 nt, Homo sapiens
aaucucaugucccaguuca

SEQ ID NO: 1591882 - RNA, 19 nt, Homo sapiens
ucgcuuaguucugccuuga

SEQ ID NO: 1591883 - RNA, 19 nt, Homo sapiens
uuuccuuccugcuuucuuu

SEQ ID NO: 1591884 - RNA, 19 nt, Homo sapiens
acccuuagcagaacagaaa

SEQ ID NO: 1591885 - RNA, 19 nt, Homo sapiens
cuugaguccugccagugua

SEQ ID NO: 1591886 - RNA, 19 nt, Homo sapiens
aauauggucgagacaauga

SEQ ID NO: 1591887 - RNA, 19 nt, Homo sapiens
cagaaaagcggaccguauu

SEQ ID NO: 1591888 - RNA, 19 nt, Homo sapiens
ggaacaguaaauaagacaa

SEQ ID NO: 1591889 - RNA, 19 nt, Homo sapiens
gaauggaagggagcucuca

SEQ ID NO: 1591890 - RNA, 19 nt, Homo sapiens
gggcuaugaugagaugagu

SEQ ID NO: 1591891 - RNA, 19 nt, Homo sapiens
aaagagaucacaccguuuu

SEQ ID NO: 1591892 - RNA, 19 nt, Homo sapiens
gaaggagggcaggauugga

SEQ ID NO: 1591893 - RNA, 19 nt, Homo sapiens
uauauucccguauuuccuu

SEQ ID NO: 1591894 - RNA, 19 nt, Homo sapiens
gcugauggagggauguguu

SEQ ID NO: 1591895 - RNA, 19 nt, Homo sapiens
ggccaggaaugagcaccuu

SEQ ID NO: 1591896 - RNA, 19 nt, Homo sapiens
gauccaauggccuuguuag

SEQ ID NO: 1591897 - RNA, 19 nt, Homo sapiens
gaaucagcauaauuuaacc

SEQ ID NO: 1591898 - RNA, 19 nt, Homo sapiens
cugauggagggauguguua

SEQ ID NO: 1591899 - RNA, 19 nt, Homo sapiens
ccuggaacuuuggcuuuga

SEQ ID NO: 1591900 - RNA, 19 nt, Homo sapiens
cagcccaggugugcuagga

SEQ ID NO: 1591901 - RNA, 19 nt, Homo sapiens
cgaauguagaaucagcaua

SEQ ID NO: 1591902 - RNA, 19 nt, Homo sapiens
gcccagcggaaacaccuuu

SEQ ID NO: 1591903 - RNA, 19 nt, Homo sapiens
uaacuuucacucccugcuu

SEQ ID NO: 1591904 - RNA, 19 nt, Homo sapiens
cagcuucugggcauucuau

SEQ ID NO: 1591905 - RNA, 19 nt, Homo sapiens
aaaucgcccucagaauaug

SEQ ID NO: 1591906 - RNA, 19 nt, Homo sapiens
ggaauccggcagagcucaa

SEQ ID NO: 1591907 - RNA, 19 nt, Homo sapiens
agacuuugauucgcuuagu

SEQ ID NO: 1591908 - RNA, 19 nt, Homo sapiens
ggagggcaggauuggagaa

SEQ ID NO: 1591909 - RNA, 19 nt, Homo sapiens
gagacaaugaaacaagaca

SEQ ID NO: 1591910 - RNA, 19 nt, Homo sapiens
uuaaagggaacugaugaga

SEQ ID NO: 1591911 - RNA, 19 nt, Homo sapiens
uauccuuguucucaccuau
